United States Patent
Inoue et al.

(10) Patent No.: US 7,892,769 B2
(45) Date of Patent: Feb. 22, 2011

(54) PROCESSING OF EPHA4 POLYPEPTIDE BY γ-SECRETASE ACTIVITY

(75) Inventors: Eiji Inoue, Kobe (JP); Maki Tawarada, Kobe (JP); Aki Togawa, Kobe (JP); Emiko Kamakura, Tsukuba (JP)

(73) Assignee: Eisai R&D Management Co., Ltd., Tokyo (JP)

( * ) Notice: Subject to any disclaimer, the term of this patent is extended or adjusted under 35 U.S.C. 154(b) by 0 days.

(21) Appl. No.: 12/325,418

(22) Filed: Dec. 1, 2008

(65) Prior Publication Data

US 2009/0275049 A1    Nov. 5, 2009

Related U.S. Application Data

(60) Provisional application No. 60/991,312, filed on Nov. 30, 2007.

(51) Int. Cl.
G01N 33/567 (2006.01)
G01N 33/48 (2006.01)
G01N 33/53 (2006.01)
C12N 15/63 (2006.01)

(52) U.S. Cl. ............... 435/7.21; 435/7.1; 435/455

(58) Field of Classification Search .............. None
See application file for complete search history.

(56) References Cited

U.S. PATENT DOCUMENTS

2009/0142788 A1   6/2009   Inoue

FOREIGN PATENT DOCUMENTS

WO    WO 2006/056467 A1 *   6/2006
WO    WO-2008/150010 A1    12/2008

OTHER PUBLICATIONS

E. Inoue et al., "Synaptic activity prompts γ-secretase-mediated cleavage of EphA4 and dendritic spine formation", J.Cell Biol., 2009. vol. 185, No. 3, p. 551-564.

"EphA Receptors Regulate Growth Cone Dynamics through the Novel Guanine Nocleotide Exchange Factor Ephexin" by Shamah et al., Cell, vol. 105, Apr. 20, 2001, pp. 233-244.

"Control of hippocampal dendritic spine morphology through ephrin-A3/EphA4 signaling", by Murai at al., Published online Dec. 23, 2002, doi:10.1038/nn994, nature neuroscience, vol. 6, No. 2, Feb. 2003.

* cited by examiner

*Primary Examiner*—Elizabeth C. Kemmerer
*Assistant Examiner*—Kimberly A. Ballard
(74) *Attorney, Agent, or Firm*—Clark & Elbing LLP

(57) ABSTRACT

The present invention provides EphA4 polypeptides which encode EphA4 fragments cleaved by γ-secretase, especially intracellular fragments of such cleaved fragments, polynucleotides which encode such polypeptides, and antibodies specific to such polypeptides. Also disclosed is a method of screening for compounds which affect the processing of EphA4 by γ-secretase; a method of screening for compounds which affect dendritic spine formation by EphA4 processed by γ-secretase (γ-secretase-processed EphA4); and a method of screening for compounds which affect Rac activity mediated by γ-secretase-processed EphA4.

12 Claims, 8 Drawing Sheets ved by γ-secretase. It is another object of the present invention to provide a method of screening for compounds which affect the processing of EphA4 by γ-secretase; a method of screening for compounds which affect spine formation by EphA4 processed by γ-secretase

PROCESSING OF EPHA4 POLYPEPTIDE BY γ-SECRETASE ACTIVITY

CROSS-REFERENCE TO RELATED APPLICATIONS

This application claims priority to U.S. Provisional Application No. 60/991,312 filed on Nov. 30, 2007, which is herein incorporated by reference in its entirety.

TECHNICAL FIELD

The present invention generally relates to EphA4 polypeptides and use thereof. Specifically, the present invention relates to EphA4 polypeptides with a novel activity and use thereof.

BACKGROUND OF THE INVENTION

γ-Secretase is a complex protein (aspartate protease) comprising presenilin, nicastrin, Aph-1 and Pen-2 as basic components. Presenilin is the catalytic domain; presenilin gene has been identified as a causative gene for familial Alzheimer's disease (AD). γ-Secretase acts on single-pass transmembrane proteins as its substrates. As most representative substrates thereof, amyloid precursor protein (APP) and Notch are known. When cleaved by β-secretase at β-site and by γ-secretase at γ-site, APP produces amyloid β protein (Aβ). The thus-produced Aβ is classified into peptides with different lengths depending on the cleavage site in the amino acid sequence (C-terminal side). Of these peptides, Aβ42 which is strongly hydrophobic and ready to aggregate (ready to take the β-sheet structure) exhibits neurotoxicity. It has been considered that this phenomenon may be the major cause of Alzheimer's disease. Recently, however, a report has been made that presenilin 1 (PS1) and presenilin 2 (PS2) double-knockout mice capable of producing no Aβ show AD-like phenotypes such as decrease in synapses and neuronal death; this suggests existence of a pathogenic mechanism of AD independent from APP (Non Patent Document 1).

On the other hand, Eph receptor A4 (EphA4) is a member of the receptor tyrosine kinase family, and is a molecule regulating the morphogenesis of postsynapses. It is known that EphA4 knockout or expression of EphA4 dominant-negative mutants causes decrease in the number of spines (small, thorn-like protrusions found on dendrites) and makes the spine shape slender (Non Patent Document 2). It is generally proposed that the processes of memory and learning are reflected on the number and morphology of spines.

As molecules known to be involved in neural activity, Rho family proteins which are small GTP-binding proteins belonging to the Ras super family are known to regulate rearrangement of intracellular skeletons, particularly actin cytoskeleton. As representative molecules of Rho family proteins, RhoA, Cdc42 and Rac1 may be enumerated. It is known that these molecules are strongly expressed in the central nervous system. Especially, in spines where rearrangement of actin is vigorously performed, RhoA, Cdc42 and Rac1 are playing central roles. It is known that when these signal transduction pathways are broken, spines are attenuated and various neuronal disorders are caused (Non Patent Document 3). In particular, Rac-mediated signal transduction pathway functions to promote spine formation and, when its signals are inhibited, attenuation of spines occurs (Non Patent Document 5). It has already been reported that EphA4 is involved in regulation of the activities of Rho family molecules. When EphA4 is bound to ephrinA (ligand of EphA4 receptor), i.e., in a state that EphA4 is not processed by γ-secretase, EphA4 is known to inhibit Rac-mediated signal transduction pathway to thereby inhibit spine formation (Non Patent Document 4). Further, it is also known that Rac is deeply involved in the pathogenic mechanism of Alzheimer's disease. It is reported that p21-activated kinase (PAK) whose activity is regulated by Rac is decreased in both expression and activity in the brain of Alzheimer patients (Non Patent Document 6).

However, no report has been made to date as to the relationship between EphA4 and γ-secretase. It has not been reported that γ-secretase processes EphA4. Furthermore, no report has been made also as to the identification of EphA4 fragments processed by γ-secretase and the effect of such fragments in the body, especially the effect of EphA4 processing by γ-secretase upon the activities of Rho family molecules and upon spine formation.

[Non Patent Document 1] Saura C A, Choi S Y, Beglopoulos V, Malkani S, Zhang D, Shankaranarayana Rao B S, Chattarji S, Kelleher R J 3rd, Kandel E R, Duff K, Kirkwood A, and Shen J., Loss of presenilin function causes impairments of memory and synaptic plasticity followed by age-dependent neurodegeneration. Neuron. 2004 Apr. 8; 42(1):23-36.

[Non Patent Document 2] Murai K K, Nguyen L N, Irie F, Yamaguchi Y, Pasquale E B. Control of hippocampal dendritic spine morphology through ephrin-A3/EphA4 signaling. Nat. Neurosci. 2003 February; 6(2):153-60.

[Non Patent Document 3] Ramakers G J. Rho proteins, mental retardation and the cellular basis of cognition. Trends Neurosci. 2002 April; 25(4):191-9.

[Non Patent Document 4] Shamah S M, Lin M Z, Goldberg J L, Estrach S, Sahin M, Hu L, Bazalakova M, Neve R L, Corfas G, Debant A, Greenberg M E., EphA receptors regulate growth cone dynamics through the novel guanine nucleotide exchange factor ephexin. Cell. 2001 Apr. 20; 105(2):233-44.

[Non Patent Document 5] Tashiro A, Yuste R., Regulation of dendritic spine motility and stability by Rac1 and Rho kinase: evidence for two forms of spine motility. Mol Cell Neurosci. 2004 July; 26(3):429-40.

[Non Patent Document 6] Zhao L, Ma Q L, Calon F, Harris-White M E, Yang F, Lim G P, Morihara T, Ubeda O J, Ambegaokar S, Hansen J E, Weisbart R H, Teter B, Frautschy S A, Cole G M. Role of p21-activated kinase pathway defects in the cognitive deficits of Alzheimer disease. Nat. Neurosci. 2006 February; 9(2):234-42. Epub 2006 Jan. 15.

SUMMARY OF THE INVENTION

Problem for Solution by the Invention

It is an object of the present invention to provide EphA4 polypeptides with a novel activity and use thereof. Specifically, the present invention aims at providing those polypeptides which encode EphA4 fragments cleaved by γ-secretase (especially, intracellular fragments of such cleaved fragments), polynucleotides which encode such polypeptides, and antibodies specific to such polypeptides. It is another object of the present invention to provide a method of screening for compounds which affect the processing of EphA4 by γ-secretase; a method of screening for compounds which affect spine formation by EphA4 processed by γ-secretase (γ-secretase-processed EphA4); and a method of screening for compounds which affect Rac activity mediated by γ-secretase-processed EphA4.

Means to Solve the Problem

The present inventors have proved that EphA4 is cleaved by γ-secretase in HEK293 cells and primary culture of hippocampal neurons by using a γ-secretase inhibitor (2S)-2-{[(3,5-difluorophenyl)acetyl]amino}-N-[(3S)-1-methyl-2-oxo-5-phenyl-2,3-dihydro-1H-1,4-benzodiazepin-3-yl]propanamide. The present inventors have also found that it is possible to detect the cleavage of EphA4 by γ-secretase by using an antibody specific to cleaved EphA4 or an antibody specific to a tag at the C-terminus of EphA4.

Further, the present inventors have forced primary culture of hippocampal neurons to express EphA4 intracellular fragment cleaved by γ-secretase and then detected the number of spines in the neurons before and after the forced expression, to thereby find for the first time that EphA4 intracellular fragment cleaved by γ-secretase activates spine formation.

Further, the present inventors have forced NIH3T3 cells to express EphA4 intracellular fragment cleaved by γ-secretase and then observed structural changes in actin cytoskeletons in the NIH3T3 cells before and after the forced expression, to thereby find for the first time that EphA4 intracellular fragment cleaved by γ-secretase forms a construct called lamellipodia on the cell membrane of NIH3T3 cells.

Further, when the present inventors forced NIH3T3 cells to simultaneously express EphA4 intracellular fragment cleaved by γ-secretase and Rac1N17 which is a dominant negative Rac1 obtained by substituting threonine at position 17 with asparagine, the lamellipodia structure formed by the forced expression of EphA4 intracellular fragment cleaved by γ-secretase was eliminated. The present inventors have found for the first time that EphA4 intracellular fragment cleaved by γ-secretase activates Rac1.

Further, the present inventors have found for the first time a region corresponding to EphA4 intracellular fragment cleaved by γ-secretase and determined for the first time a domain in the above region necessary for the activation of Rac1 and spine formation.

Briefly, by showing that cleavage of EphA4 is inhibited by a γ-secretase inhibitor, the present inventors have demonstrated that a screening method with EphA4 utilizing the EphA4 degrading activity of γ-secretase (especially, cleavage promoting activity or cleavage inhibitory activity) is effective.

Further, the present inventors showed that EphA4 intracellular fragment cleaved by γ-secretase activates spine formation because when neurons are forced to express EphA4 intracellular fragment cleaved by γ-secretase, the number of spines is increased in the neurons after the expression. Thus, the present inventors have demonstrated that a screening method utilizing the spine formation activity by cleaved EphA4 intracellular fragment is effective.

Further, the present inventors showed that EphA4 intracellular fragment cleaved by γ-secretase promotes Rac activity because when NIH3T3 cells are forced to express EphA4 intracellular fragment cleaved by γ-secretase, the formation of lamellipodia structure is promoted in the NIH3T3 cells after the expression. Thus, the present inventors have demonstrated that a screening method utilizing the Rac activity mediated by cleaved EphA4 intracellular fragment is effective.

Further, the present inventors performed EphA4 cleavage reaction by γ-secretase, obtained from the reaction products affinity-purified tagged EphA4 protein fragments using an antibody specific to a tag at the C-terminus of EphA4, separated the tagged EphA4 protein fragments by SDS-PAGE, and cut out a gel section containing the fragments. The gel section was subjected to digestion with protease. The resultant peptide sections were subjected to LC-MS/MS analysis to thereby find peptides containing a cleavage site. By analysis of tandem MS spectra, the amino acid sequence of the site of EphA4 at which EphA4 is cleaved by γ-secretase has been determined for the first time.

Further, a sequence having a Rac activating capacity similar to the Rac activating capacity of EphA4 intracellular fragment cleaved by γ-secretase has been found for the first time by measuring the Rac activating capacities of mutants of EphA4 intracellular fragment which were created by serially deleting the amino acid sequence of EphA4 intracellular fragment cleaved by γ-secretase from the N-terminus. Then, the present inventors have demonstrated that EphA4 intracellular fragment cleaved by γ-secretase and a fragment which activates Rac in the same manner as the intracellular fragment are effective.

Further, the present inventors have demonstrated that EphA4 intracellular fragment cleaved by γ-secretase and a fragment which promotes spine formation in the same manner as the intracellular fragment are effective because spine formation is promoted when Rac is activated.

Further, the present inventors have also shown antibodies specific to EphA4 cleaved by γ-secretase.

A cleavage inhibitor for γ-secretase obtainable by the screening method of the present invention is a compound which reduces the processing of EphA4 through γ-secretase and, at the same time, reduces spine formation through EphA4 intracellular fragment processed by γ-secretase.

A cleavage accelerator for γ-secretase obtainable by the screening method of the present invention is a compound which increases the processing of EphA4 through γ-secretase and, at the same time, activates spine formation through EphA4 intracellular fragment processed by γ-secretase.

A spine formation inhibitor through γ-secretase-processed EphA4 intracellular fragment obtainable by the screening method of the present invention is a compound which inhibits spine formation by decreasing the number of spines through inhibition of the production of γ-secretase-processed EphA4 intracellular fragment.

A spine formation accelerator through γ-secretase-processed EphA4 intracellular fragment obtainable by the screening method of the present invention is a compound which accelerates spine formation by increasing the number of spines through acceleration of the production of γ-secretase-processed EphA4 intracellular fragment.

A degradation inhibitor for γ-secretase-processed EphA4 intracellular fragment obtainable by the screening method of the present invention is a compound which inhibits the degradation of EphA4 intracellular fragment produced from processing by γ-secretase. The compound which inhibits the degradation of EphA4 intracellular fragment is a compound that accelerates spine formation by increasing the effective quantity of EphA4 intracellular fragment and activates spine formation through inhibition of the degradation of γ-secretase-processed EphA4 intracellular fragment.

A Rac activator by γ-secretase-processed EphA4 intracellular fragment obtainable by the screening method of the present invention is a compound which accelerates Rac activity through acceleration of the production of γ-secretase-processed EphA4 intracellular fragment and, at the same time, a compound which accelerates spine formation by increasing the number of spines through Rac activation.

A Rac inhibitor by γ-secretase-processed EphA4 intracellular fragment obtainable by the screening method of the present invention is a compound which inhibits Rac activity through inhibition of the production of γ-secretase-processed EphA4 intracellular fragment and, at the same time, a compound which inhibits spine formation by decreasing the number of spines through inhibition of Rac activity.

According to the present invention, it becomes possible to develop therapeutics for memory disorders of interest, especially dementia (preferably AD), by selecting compounds which selectively act upon spine formation by γ-secretase, spine formation by γ-secretase-processed EphA4 intracellular fragment or degradation of γ-secretase-processed EphA4 intracellular fragment; or γ-secretase-processed EphA4 intracellular fragments or antibodies specific to such fragments (especially cleavage accelerator for γ-secretase, spine formation accelerator, or degradation inhibitor for γ-secretase-processed EphA4 intracellular fragment; or γ-secretase-processed EphA4 intracellular fragments or antibodies specific to such fragments).

The present invention provides the following embodiments.

(1) A polynucleotide consisting of a partial sequence of a polynucleotide encoding the amino acid sequence as shown in SEQ ID NO: 2, wherein the former polynucleotide encodes a polypeptide consisting of a partial amino acid sequence of SEQ ID NO: 2 whose N-terminus starts between positions 564 and 621 of SEQ ID NO: 2.

(2) The polynucleotide according to (1) above, wherein the polynucleotide encodes the amino acid sequence of a polypeptide having the following activity (a) or (b):
  (a) promoting spine formation; or
  (b) activating Rac.

(3) A polynucleotide consisting of a partial sequence of a polynucleotide encoding the amino acid sequence as shown in SEQ ID NO: 2, wherein the former polynucleotide has the following nucleotide sequence (a) or (b) and yet encodes the amino acid sequence of a polypeptide having the following activity (c) or (d):
  (a) a nucleotide sequence having at least 95% or more homology to a nucleotide sequence encoding a polypeptide consisting of a partial amino acid sequence of SEQ ID NO: 2 whose N-terminus starts between positions 564 and 621 of SEQ ID NO: 2; or
  (b) a nucleotide sequence which hybridizes to the complementary strand of a nucleotide sequence encoding a polypeptide consisting of a partial amino acid sequence of SEQ ID NO: 2 whose N-terminus starts between positions 564 and 621 of SEQ ID NO: 2 under stringent conditions;
  (c) promoting spine formation; or
  (b) activating Rac.

(4) A polynucleotide selected from the following (a), (b) and (c):
  (a) a polynucleotide encoding the amino acid sequence as shown in SEQ ID NO: 2n where n represents an integer from 45 to 83;
  (b) a polynucleotide consisting of the nucleotide sequence as shown in SEQ ID NO: 2n−1 where n represents an integer from 45 to 83; and
  (c) a polynucleotide which hybridizes to the complementary strand of the polynucleotide (a) or (b) under stringent conditions and yet encodes a polypeptide having the following activity (d) or (e):
  (d) promoting spine formation; or
  (e) activating Rac.

(5) A polynucleotide encoded by the nucleotide sequence as shown in SEQ ID NO: 89, 91 or 195.

(6) The polynucleotide according to any one of (1) to (5) above, wherein the polynucleotide encodes an amino acid sequence of a fusion protein.

(7) A polypeptide consisting of a partial sequence of a polypeptide having the amino acid sequence as shown in SEQ ID NO: 2, wherein the N-terminus of the partial sequence starts between positions 564 and 621 of SEQ ID NO: 2.

(8) The polypeptide according to (7) above, wherein the polypeptide has the following activity (a) or (b):
  (a) promoting spine formation; or
  (b) activating Rac.

(9) A polypeptide consisting of a partial sequence of a polypeptide consisting of the amino acid sequence as shown in SEQ ID NO: 2, wherein the former polypeptide has the following amino acid sequence (a) or (b) and yet has the following activity (c) or (d):
  (a) an amino acid sequence having at least 95% or more homology to a partial amino acid sequence of SEQ ID NO: 2 whose N-terminus starts between positions 564 and 621 of SEQ ID NO: 2; or
  (b) an amino acid sequence encoded by a polynucleotide which hybridizes to the complementary strand of a polynucleotide encoding a partial amino acid sequence of SEQ ID NO: 2 whose N-terminus starts between positions 564 and 621 of SEQ ID NO: 2 under stringent conditions;
  (c) promoting spine formation; or
  (d) activating Rac.

(10) A polypeptide selected from the following (a) and (b):
  (a) a polypeptide consisting of the amino acid sequence as shown in SEQ ID NO: 2n where n represents an integer from 45 to 83;
  (b) a polypeptide which has at least 80% or more homology to a polypeptide consisting of the amino acid sequence as shown in SEQ ID NO: 2n where n represents an integer from 45 to 83 and yet has the following activity (c) or (d):
  (c) promoting spine formation; or
  (d) activating Rac.

(11) A polypeptide having the amino acid sequence as shown in SEQ ID NO: 90, 92 or 196.

(12) The polypeptide according to any one of (7) to (10) above, wherein the polypeptide has an amino acid sequence of a fusion protein.

(13) An antibody to the polypeptide according to any one of (7) to (12).

(14) A kit containing the polynucleotide according to any one of (1) to (6) above and the antibody according to (13) above.

(15) A kit containing the polypeptide according to any one of (7) to (12) above and the antibody according to (13) above.

(16) A method of screening for compounds which affect the processing of EphA4 by γ-secretase, comprising the following steps:
  (i) contacting a first biological composition containing γ-secretase or a biologically active fragment thereof with a second biological composition containing EphA4 in the presence and absence of a candidate compound;
  (ii) measuring the number of spines in spine forming cells in the presence and absence of the candidate compound;

(iii) selecting those candidate compounds which affect the number of spines based on the number of spines measured in step (ii); and (iv) identifying the candidate compounds selected in step (iii) as compounds which affect the processing of EphA4 by γ-secretase.

(17) The method according to (16) above, comprising identifying a candidate compound as a compound which activates the processing of EphA4 through γ-secretase when the number of spines in the presence of said candidate compound was increased relative to the number of spines in the absence of said candidate compound in the measurement of spines in step (ii).

(18) The method according to (16) above, comprising identifying a candidate compound as a compound which inhibits the processing of EphA4 through γ-secretase when the number of spines in the presence of said candidate compound was decreased relative to the number of spines in the absence of said candidate compound in the measurement of spines in step (ii).

(19) A method of screening for compounds which affect spine formation by γ-secretase-processed EphA4, comprising the following steps:

(i) culturing spine forming cells which have expressed intracellular EphA4 cleaved by γ-secretase;

(ii) measuring the number of spines in the spine forming cells cultured in step (i) in the presence and absence of a candidate compound;

(iii) selecting those candidate compounds which affect the number of spines based on the number of spines measured in step (ii); and (iv) identifying the candidate compounds selected in step (iii) as compounds which affect spine formation by γ-secretase-processed EphA4.

(20) The method according to (19) above, comprising evaluating a candidate compound as a compound which activates spine formation through γ-secretase-cleaved EphA4 when the number of spines after the expression of γ-secretase-cleaved EphA4 was increased relative to the number of spines before the expression of γ-secretase-cleaved EphA4 in the measurement of spines in step (ii).

(21) The method according to (19) above, comprising evaluating a candidate compound as a compound which inhibits spine formation through EphA4 when the number of spines after the expression of γ-secretase-cleaved EphA4 was decreased relative to the number of spines before the expression of γ-secretase-cleaved EphA4 in the measurement of spines in step (ii).

(22) A method of screening for compounds which affect spine formation by γ-secretase-processed EphA4, comprising the following steps:

(i) culturing Rac expressing cells which have expressed intracellular EphA4 cleaved by γ-secretase;

(ii) measuring Rac activity in the Rac expressing cells cultured in step (i) in the presence and absence of a candidate compound;

(iii) selecting those candidate compounds which affect Rac activity based on the measuring in step (ii); and (iv) identifying the candidate compounds selected in step (iii) as compounds which affect spine formation by γ-secretase-processed EphA4.

(23) The method according to (22) above, comprising evaluating a candidate compound as a compound which activates spine formation through γ-secretase-cleaved EphA4 when the Rac activity in the presence of said candidate compound was increased relative to the Rac activity in the absence of said candidate compound in the measurement of Rac activity in step (ii).

(24) The method according to (22) above, comprising evaluating a candidate compound as a compound which inhibits spine formation through EphA4 when the Rac activity in the presence of said candidate compound was decreased relative to the Rac activity in the absence of said candidate compound in the measurement of Rac activity in step (ii).

(25) A method of screening for compounds which affect Rac activity mediated by γ-secretase-processed EphA4, comprising the following steps:

(i) culturing Rac expressing cells which have expressed intracellular EphA4 cleaved by γ-secretase;

(ii) measuring Rac activity in the Rac expressing cells cultured in step (i) in the presence and absence of a candidate compound;

(iii) selecting those candidate compounds which affect Rac activity based on the measuring in step (ii); and (iv) identifying the candidate compounds selected in step (iii) as compounds which affect Rac activity mediated by γ-secretase-processed EphA4.

(26) The method according to (25) above, comprising evaluating a candidate compound as a compound which activates Rac through γ-secretase-cleaved EphA4 when the Rac activity in the presence of said candidate compound was increased relative to the Rac activity in the absence of said candidate compound in the measurement of Rac activity in step (ii).

(27) The method according to (25) above, comprising evaluating a candidate compound as a compound which inhibits Rac activity through EphA4 when the Rac activity in the presence of said candidate compound was decreased relative to the Rac activity in the absence of said candidate compound in the measurement of Rac activity in step (ii).

Effect of the Invention

According to the present invention, there are provided EphA4 polypeptides processed by γ-secretase and antibodies specific to the polypeptides.

Further, there are also provided a method of screening for compounds which affect the processing of EphA4 by γ-secretase; a method of screening for compounds which affect spine formation by γ-secretase-processed EphA4; a method of screening for compounds which affect Rac activity mediated by γ-secretase-processed EphA4; polynucleotides encoding EphA4 intracellular fragments cleaved by γ-secretase and polypeptide encoded by the polynucleotides; and polynucleotides encoding a Rac activating domain in those intracellular fragments and polypeptides encoded by the polynucleotides. With the compounds screened by the method of the present invention, it becomes possible to develop therapeutics for memory disorders of interest, especially dementia (preferably AD).

DETAILED DESCRIPTION OF THE INVENTION

Figure 1:
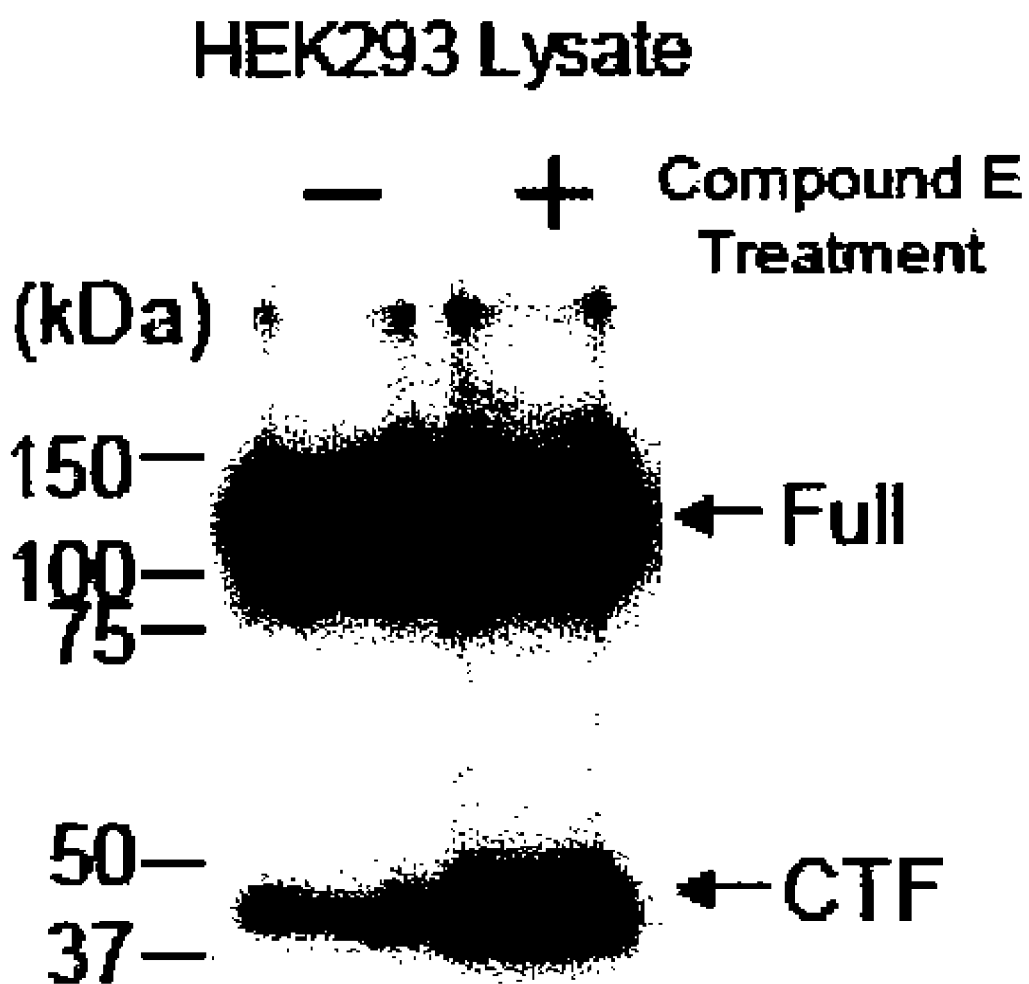
FIG. 1 shows the results of analysis of EphA4 processing using EphA4-transfected 293/EBNA-1 cell strain.

Hereinbelow, the present invention will be described in detail. The present specification encompasses the contents disclosed in the specification and the drawings of U.S. Provisional Patent Application No. 60/991,312 (filed on Nov. 30, 2007) based on which the present patent application claims priority.

The term "patient" used herein refers to an animal, preferably a mammal.

The term "mammal" used herein means any animal classified as mammal, including human and non-human mammals (such as mouse, rat, hamster, guinea pig, rabbit, pig, dog, horse, cattle, monkey, etc.). Preferably, the mammal in the present specification is human. When the mammal is human, the term "patient" include adults and children, and also male and female. Children include newborn infants, infants and adolescents.

The term "γ-secretase" used herein means an enzyme or a complex composed of a plurality of molecules, each of which is in charge of the production of Aβ by cleaving (degrading) APP within its transmembrane domain. The plurality of molecules comprise at least one molecule selected from presenilin, nicastrin, Aph-1 and Pen-2. Examples of the γ-secretase of the present invention include mouse Presenilin 1 (NM_008943), rat Presenilin 1 (D82363), human Presenilin 1 (NM_000021), mouse Presenilin 2 (NM_011183) rat Presenilin 2 (NM_031087), human Presenilin 2 (NM_000447), mouse Nicastrin (NM_021607), rat Nicastrin (NM_174864), human Nicastrin (NM_015331), mouse Aph-1 (NM_146104), rat Aph-1 (NM_001014255), human Aph-1 (NM_016022), mouse Pen-2 (NM_025498), rat Pen-2 (NM_001008764) and human Pen-2 (NM_172341). Each component molecule of the γ-secretase of the present invention may be a full-length molecule or a part thereof, as long as that γ-secretase has an enzyme activity equivalent to that of γ-secretase functioning in vivo. Further, the γ-secretase of the present invention may be a mutant γ-secretase. The mutant γ-secretase is a polypeptide composed of full-length component molecules which may have deletion, substitution, insertion and/or addition of one or more (preferable one or several) amino acids, or a polypeptide having an amino acid sequence comprising a combination of such mutations, each of the above polypeptide having an enzyme activity equivalent to that of γ-secretase functioning in vivo.

The term "cleavage of EphA4" used herein refers to an event in which EphA4, cut by γ-secretase, produces a fragment shorter than the initial EphA4 before cutting. The term "EphA4 undegraded product" used herein refers to a polypeptide which is produced as a result of non-cleavage of EphA4; this polypeptide means the EphA4 polypeptide before degradation by γ-secretase.

The term "biologically active fragment of γ-secretase" means a fragment having an enzyme activity equivalent to that of γ-secretase functioning in vivo. Examples of such fragments include fragments capable of cleaving APP or EphA4.

It should be noted that sometimes, the term "γ-secretase" is intended to include the "biologically active fragment of γ-secretase" in the present specification.

The term "EphA4" used herein refers to a known polypeptide which is a regulatory factor for synapse formation and/or maintenance (Murai K K et al., Nat. Neurosci. 2003 February; 6(2):153-60). The EphA4 of the present invention include human EphA4 (NM_004438.3, BC026327), rheus monkey (*Macaca mulatta*) EphA4 (XM_001106493.1, XM_001106620, XM_001106561, XM_001106876, XM_001106943, XM_001106806), chimpanzee (*Pan troglodytes*) EphA4 (XM_001164636.1, XM_001164828, XM_526042, XM_001164899, XM_001164862, XM_001164676), rat EphA4 (XM_244186), mouse EphA4 (NM_007936.3, BC052164, X65138, BC004782, AK132203), gray short-tailed opossum (*Monodelphis domestica*) EphA4 (XM_001365826), dog (*Canis familiaris*) EphA4 (XM_536084), chicken (*Gallus gallus*) EphA4 (NM_204781), African clawed frog (*Xenopus laevis*) EphA4 (NM_001085992, L26099, NM_001096714) and zebra fish (*Danio rerio*) EphA4 (NM_001005919, XM_001342436). Among them, mammal EphA4 polypeptides are preferable. EphA4 comprises a γ-secretase cleavage site, a transmembrane domain and a kinase activity site in its structure; the ligand thereof is the Ephrin A family (Aoto, J et al., Brain Res 2006 11). In the present invention, EphA4 may be a polypeptide derived from any of the above-listed animals, a recombinant polypeptide or a synthetic polypeptide. The EphA4 of the present invention may be either a full-length polypeptide or a partial polypeptide thereof, as long as it comprises the γ-secretase cleavage site of EphA4. The mutant EphA4 is a full-length EphA4 polypeptide which may have deletion, substitution, insertion and/or addition of one or more (preferable one or several) amino acids, or a polypeptide having an amino acid sequence comprising a combination of such mutations, each of the above polypeptide being functionally substantially identical with EphA4. The polypeptide which is "functionally substantially identical with EphA4" means a polypeptide having an activity of EphA4, for example, a polypeptide which has a cleavage activity in a γ-secretase-dependent manner.

Table 1 below shows correspondence between various animal-derived EphA4 polypeptides and their nucleotide or amino acid sequences. Table 2 below shows correspondence between various animal-derived γ-secretases and their nucleotide or amino acid sequences.

TABLE 1

| Source or Type | Accession No. | Nucleotide Sequence | Amino Acid Sequence |
|---|---|---|---|
| Rat (*Rattus norvegicus*) | XM_244186.3 | SEQ ID NO: 1 | SEQ ID NO: 2 |
| Rat EphA4-HA | XM_244186 | SEQ ID NO: 3 | SEQ ID NO: 4 |
| Human (*Homo sapiens*) | NM_004438 | SEQ ID NO: 5 | SEQ ID NO: 6 |
| | BC026327 | SEQ ID NO: 7 | SEQ ID NO: 8 |
| | NP_004429.1 | SEQ ID NO: 179 | SEQ ID NO: 180 |
| | BAG35298.1 | SEQ ID NO: 181 | SEQ ID NO: 182 |
| Mouse (*Mus musculus*) | NM_007936 | SEQ ID NO: 9 | SEQ ID NO: 10 |
| | BC052164 | SEQ ID NO: 11 | SEQ ID NO: 12 |
| | X65138 | SEQ ID NO: 13 | SEQ ID NO: 14 |
| | BC004782 | SEQ ID NO: 15 | SEQ ID NO: 16 |
| | AK132203 | SEQ ID NO: 17 | SEQ ID NO: 18 |
| | AAH04782.1 | SEQ ID NO: 175 | SEQ ID NO: 176 |
| | NP_031962.2 | SEQ ID NO: 177 | SEQ ID NO: 178 |
| Gray short-tailed opossum (*Monodelphis domestica*) | XM_001365826 | SEQ ID NO: 19 | SEQ ID NO: 20 |
| Dog (*Canis lupus familiaris*) | XM_536084.2 | SEQ ID NO: 21 | SEQ ID NO: 22 |
| Chimpanzee (*Pan troglodytes*) | XM_001164636 | SEQ ID NO: 23 | SEQ ID NO: 24 |
| | XM_001164828 | SEQ ID NO: 25 | SEQ ID NO: 26 |
| | XM_526042.2 | SEQ ID NO: 27 | SEQ ID NO: 28 |
| | XM_001164899 | SEQ ID NO: 29 | SEQ ID NO: 30 |
| | XM_001164862 | SEQ ID NO: 31 | SEQ ID NO: 32 |
| | XM_001164676 | SEQ ID NO: 33 | SEQ ID NO: 34 |
| Rhesus monkey (*Macaca mulatta*) | XM_001106493 | SEQ ID NO: 35 | SEQ ID NO: 36 |
| | XM_001106620 | SEQ ID NO: 37 | SEQ ID NO: 38 |
| | XM_001106561 | SEQ ID NO: 39 | SEQ ID NO: 40 |
| | XM_001106876.1 | SEQ ID NO: 41 | SEQ ID NO: 42 |
| | XM_001106943 | SEQ ID NO: 43 | SEQ ID NO: 44 |
| | XM_001106806 | SEQ ID NO: 45 | SEQ ID NO: 46 |
| | XP_001106430.1 | SEQ ID NO: 183 | SEQ ID NO: 184 |
| Chicken (*Gallus gallus*) | NM_204781 | SEQ ID NO: 47 | SEQ ID NO: 48 |
| | CAA79509.1 | SEQ ID NO: 187 | SEQ ID NO: 188 |
| African clawed frog (*Xenopus laevis*) | NM_001085992 | SEQ ID NO: 49 | SEQ ID NO: 50 |
| | L26099 | SEQ ID NO: 51 | SEQ ID NO: 52 |
| | NM_001096714 | SEQ ID NO: 53 | SEQ ID NO: 54 |
| | NP_001079461.1 | SEQ ID NO: 193 | SEQ ID NO: 194 |
| Zebra fish (*Danio rerio*) | NM_001005919 | SEQ ID NO: 55 | SEQ ID NO: 56 |
| | XM_001342436 | SEQ ID NO: 57 | SEQ ID NO: 58 |
| Horse (*Equus caballus*) | XP_001494588.1 | SEQ ID NO: 185 | SEQ ID NO: 186 |
| Pig (*Sus scrofa*) | NP_001128439.1 | SEQ ID NO: 189 | SEQ ID NO: 190 |
| Platypus (*Ornithorhynchus anatinus*) | XP_001506050.1 | SEQ ID NO: 191 | SEQ ID NO: 192 |

TABLE 2

| Source or Type | Accession No. | Nucleotide Sequence | Amino Acid Sequence |
|---|---|---|---|
| Mouse Presenilin 1 (*Mus musculus*) | NM_008943 | SEQ ID NO: 59 | SEQ ID NO: 60 |
| Rat Presenilin 1 (*Rattus norvegicus*) | D82363 | SEQ ID NO: 61 | SEQ ID NO: 62 |
| Human Presenilin 1 (*Homo sapiens*) | NM_000021 | SEQ ID NO: 63 | SEQ ID NO: 64 |
| Mouse Presenilin 2 (*Mus musculus*) | NM_011183 | SEQ ID NO: 65 | SEQ ID NO: 66 |
| Rat Presenilin 2 (*Rattus norvegicus*) | NM_031087 | SEQ ID NO: 67 | SEQ ID NO: 68 |
| Human Presenilin 2 (*Homo sapiens*) | NM_000447 | SEQ ID NO: 69 | SEQ ID NO: 70 |
| Mouse Nicastrin (*Mus musculus*) | NM_021607 | SEQ ID NO: 71 | SEQ ID NO: 72 |
| Rat Nicastrin (*Rattus norvegicus*) | NM_174864 | SEQ ID NO: 73 | SEQ ID NO: 74 |
| Human Nicastrin (*Homo sapiens*) | NM_015331 | SEQ ID NO: 75 | SEQ ID NO: 76 |
| Mouse Aph-1 (*Mus musculus*) | NM_146104 | SEQ ID NO: 77 | SEQ ID NO: 78 |
| Rat Aph-1 (*Rattus norvegicus*) | NM_001014255 | SEQ ID NO: 79 | SEQ ID NO: 80 |

TABLE 2-continued

| Source or Type | Accession No. | Nucleotide Sequence | Amino Acid Sequence |
|---|---|---|---|
| Human Aph-1 (*Homo sapiens*) | NM_016022 | SEQ ID NO: 81 | SEQ ID NO: 82 |
| Mouse Pen-2 (*Mus musculus*) | NM_025498 | SEQ ID NO: 83 | SEQ ID NO: 84 |
| Rat Pen-2 (*Rattus norvegicus*) | NM_001008764 | SEQ ID NO: 85 | SEQ ID NO: 86 |
| Human Pen-2 (*Homo sapiens*) | NM_172341 | SEQ ID NO: 87 | SEQ ID NO: 88 |

The term "substitution" used herein means preferably conservative substitution in which one or more (preferably one or several) amino acid residues are substituted with other chemically similar amino acid residues so that the activity of the peptide is not substantially modified. Examples of conservative substitution include substitution of a hydrophobic residue with other hydrophobic residue and substitution of a polar residue with other polar residue with the same electric charge. Functionally similar amino acids which allow such substitution are known to those skilled in the art for each amino acid. Specifically, examples of non-polar (hydrophobic) amino acids include alanine, valine, isoleucine, leucine, proline, tryptophan, phenylalanine and methionine; examples of polar (neutral) amino acids include glycine, serine, threonine, tyrosine, glutamine, asparagine and cystein. Examples of positively charged (basic) amino acids include arginine, histidine and lysine. Examples of negatively charged (acidic) amino acids include aspartic acid and glutamic acid.

The number of amino acids which may be deleted, substituted, inserted and/or added as described above is, for example, 1 to 30, preferably 1 to 20, more preferably 1 to 10, still more preferably 1 to 5, particularly preferably 1 to 2.

The mutant EphA4 mentioned above is a polypeptide which consists of an amino acid sequence having preferably 80% or more, more preferably 85% or more, still more preferably 90% or more, still yet more preferably 95% or more, particularly preferably 98% or more, most preferably 99% or more homology (identity) with the amino acid sequence of SEQ ID NO: 2 and has substantially the same activity as that of EphA4 (e.g., an activity to change postsynapse morphology, especially to cause EphrinA-dependent morphological change). As long as these conditions are satisfied, the mutant EphA4 may be a polypeptide derived from any of the above-listed animals, a recombinant polypeptide or a synthetic polypeptide. The identity described above may be values calculated by homology search programs known to those skilled in the art. For example, identity can be calculated by using default parameters in the homology algorithm BLAST (Basic local alignment search tool; http://www.ncbi.nlm.nih.gov/BLAST/) of The National Center for Biotechnology Information (NCBI).

The EphA4 may take any of the following forms: a fusion polypeptide fused to other polypeptide, a tagged or labeled polypeptide or a polypeptide otherwise modified. These polypeptides may be obtained by recombinant DNA techniques, site-directed mutagenesis, treatment with mutagenic agents (such as hydroxylamine), or automated peptide synthesis. The EphA4 of the present invention includes all EphA4 derivatives comprising at least the γ-secretase cleavage site of EphA4. These polypeptides are particularly useful in detecting and purifying EphA4.

Examples of particularly useful systems as tagged EphA4 polypeptides include hemagglutinin (HA) system, glutathione-transferase (GST) system, maltose-binding protein system, 6× histidine system, 8× histidine system and the like.

For monitoring the cleavage of EphA4 by γ-secretase, any of the following antibodies may be used: an anti-EphA4 antibody; an antibody which recognizes EphA4 cleavage product produced as a result of the cleavage of EphA4; preferably, an antibody which recognizes the intercellular domain of EphA4; or still preferably, an antibody which recognizes the C-terminal domain of EphA4. When a cleavage product of tagged EphA4 polypeptide is to be detected, an antibody which recognizes the selected tag may be used. For example, when an HA tag has been added to the C-terminus of EphA4, it is possible to detect the cleavage product using an anti-HA tag antibody. In this case, the antibody is capable of clarifying the presence and concentration of a C-terminal fragment of EphA4 that is produced as a result of cleavage of EphA4.

Examples of modification incorporating the above-mentioned label or other detectable moieties include biotin label, radioactive label, fluorescence label, chemiluminescence label and the like. Any EphA4 of the present invention may be labeled with one, two or more of these labels.

In a preferred embodiment of the present invention, EphA4 is a rat EphA4 polypeptide, for example, a polypeptide comprising the amino acid sequence as shown in SEQ ID NO: 2. In a still preferred embodiment of the present invention, EphA4 is a rat EphA4 polypeptide to which an HA tag is added. For example, a rat EphA4 polypeptide with an HA tag added at its C-terminus (SEQ ID NO: 4) may be given (Example 1). It is for granted that polypeptides comprising the entire human EphA4 amino acid sequence or a part thereof (e.g., the amino acid sequence as shown in SEQ ID NO: 6 or 8) may also be used in the same manner as rat EphA4 polypeptides.

The present invention further provides a polynucleotide comprising a nucleotide sequence encoding the above-described EphA4. One example of the polynucleotide encoding the EphA4 of the present invention is a polynucleotide encoding a rat EphA4 (e.g., the polynucleotide as shown in SEQ ID NO: 1). In a preferred embodiment of the present invention, the polynucleotide encoding EphA4 is a polynucleotide encoding an HA-tagged rat EphA4 polypeptide. For example, a polynucleotide encoding a rat EphA4 polypeptide with an HA tag added at its C-terminus (SEQ ID NO: 3) may be given (Example 1). It is for granted that polynucleotides comprising the entire human EphA4 nucleotide sequence or a part thereof (e.g., the nucleotide sequence as shown in SEQ ID NO: 5 or 7) may also be used in the same manner as rat EphA4 polynucleotides.

The term "biological composition" used herein is not particularly limited as long as the composition comprises γ-secretase or EphA4. For example, the biological composition may be a cell-free reconstruction system, a mammal or a part thereof, or a transgenic non-human mammal so engineered to overexpress APP or a part of this transgenic mammal.

In the expressions "first biological composition containing γ-secretase or a biologically active fragment thereof" and "second biological composition containing EphA4" used herein, the γ-secretase and/or EphA4 may be either endogenous or exogenous. When the γ-secretase or EphA4 is endogenous, the composition may be any composition as long as it contains γ-secretase or EphA4 derived from a part of the above-mentioned animal. The term "a part of the above-mentioned animal" include tissues, cells, cell membrane fractions or purified membranes of the above-mentioned animal. As examples of the cells, cells in the central nervous system; neurons such as brain-derived neurons, cerebral cortex-derived neurons, cerebral cortex-derived primarily cultured neurons, or hippocampus-derived primarily cultured neurons; or glial cells may be enumerated. The γ-secretase or EphA4 may be in a state of being contained in a mammal or a part thereof. Alternatively, the γ-secretase or EphA4 may be a γ-secretase fraction or an EphA4 fraction of cell lysate prepared from a mammal. The cell lysate may be obtained by subjecting γ-secretase- or EphA4-containing cells to lysis with a hypotonic solution or surfactant, or to sonication or other physical disruption. Optionally, the cell lysate may be purified with some purification means such as columns. When the γ-secretase or EphA4 is exogenous, the biological composition may be γ-secretase expressing cells or EphA4 expressing cells prepared by allowing a host cell to express the whole or a part of the sequence in an expression vector comprising a polynucleotide encoding the individual molecules constituting γ-secretase or a polynucleotide encoding EphA4. Alternatively, the biological composition may be the γ-secretase fraction of a cell lysate derived from γ-secretase expressing cells, or the EphA4 fraction or cell membrane fraction of a cell lysate derived from EphA4 expressing cells. The cell lysate may be obtained by subjecting γ-secretase- or EphA4-containing cells to lysis with a hypotonic solution or surfactant, or to sonication or physical disruption. Optionally, the cell lysate may be purified with some purification means such as columns. The expression vector may be a vector which is transformed or transfected into a host cell and temporarily expresses the gene of interest. Alternatively, the expression vector may be a vector which is integrated into the genome of a host cell and expresses the gene of interest stably.

The term "transformation" or "transfection" used herein means any and all methods which change DNA contents in eukaryotic cells. These methods include calcium phosphate transfection, protoplast fusion transfection, electroporation transfection, DEAE-dextran transfection, liposome transfection, polybrene transfection and direct microinjection transfection (Sambrook, et al., Molecular Cloning 3: 16.30-16.31 (1989)).

The expression vector used in the above-described transformation or transfection is not particularly limited as long as the vector comprises a polynucleotide encoding the individual molecules constituting γ-secretase or a polynucleotide encoding EphA4. Such an expression vector may be a plasmid obtainable by introducing the polynucleotide into a known expression vector selected appropriately depending on the host cell to be used. In mammal cells, in order to give a strong transcription activity, CMV immediate early promoter, retrovirus promoters (e.g., LTR from MLV or MMTV), promoters of SV40, RSV LTR, HIV-1 LTR and HIV-2 LTR, adenovirus promoters (e.g., those from E1A region, E2A region or MLP region), and promoters of AAV LTR, cauliflower mosaic virus, HSV-TK and avian sarcoma virus may be used.

The above-described transformed or transfected host cell is not particularly limited as long as the host cell comprises a polynucleotide encoding the individual molecules constituting γ-secretase or a polynucleotide encoding EphA4. For example, the transformed cell may be a transformant in which the polynucleotide has been integrated into the chromosome thereof. Alternatively, the transformed cell may be a transformant comprising the polynucleotide in the form of a plasmid. It is also possible that the transformed cell is a transformant which is not expressing γ-secretase or EphA4. These transformants may be obtained by transforming a desired host cell with the above-mentioned plasmid or the above-described polynucleotide per se.

The host cell into which the above-described expression vector is to be transformed or transfected may be any cell or cell line capable of expressing the gene of interest. Known cultured cells may be used as host cells. Examples of mammal cells or cell lines which may be used as host cells include HEK 293 cells, Chinese hamster ovary (CHO) cells, fibroblast cells, primary endothelial cells (HUVEC cells), human glioma cells, HeLa cells, COS cells, PC12 cells, lymphoblast cells, melanoma cells, hybridoma cells, oocytes and embryonic stem cells. Known microorganisms such as *Escherichia coli*, yeast or insect cells (e.g., BmN4 cells) may also be used. The above-listed cells may be either endogenous or exogenous. Any cell may be used as long as the cell is expressing at least one substance selected from the following: γ-secretase, EphA4, an enzyme that cuts the extracellular domain of EphA4 (MMP: matrix metalloproteinase) and other substrate for γ-secretase (e.g., APP or Notch).

Examples of the above-mentioned expression vector include pUC, pTV, pGEX, pKK or pTrcHis for *E. coli*; pEMBLY or pYES2 for yeast; pcDNA3, pMAMneo and pBabe Puro for CHO cells, HEK293 cells or COS cells; and a vector comprising the polyhedrin promoter of *Bombyx mori* nuclear polyhedrosis virus (BmNPV) (such as pBK283) for BmN4 cells.

The above-described cell containing γ-secretase and/or EphA4 is not particularly limited as long as the cell is expressing γ-secretase and/or EphA4 on the surface of its cell membrane. As examples of such cells, a cell expressing endogenous γ-secretase and endogenous EphA4, a cell expressing γ-secretase and EphA4 one of which is endogenous and the other is exogenous, or a cell expressing exogenous γ-secretase and exogenous EphA4 may be given. Such cells may be obtained by culturing under conditions which allow expression of γ-secretase and/or EphA4. Alternatively, such cells may be obtained by injecting into an appropriate cell an RNA encoding the individual molecules constituting γ-secretase and/or an RNA encoding EphA4 and culturing the resultant cell under conditions which allow expression of γ-secretase and/or EphA4.

The above-described cell membrane fraction may be obtained, for example, by disrupting cells expressing the γ-secretase or EphA4 of the present invention and isolating cell membrane-rich fractions. As methods for disrupting cells, homogenizing in a homogenizer; disrupting in a Waring blender or Polytron; disrupting by sonication; ejecting cells from a thin nozzle while applying pressure with a French press; and so on may be used. As methods for fractionating cell membrane, fractionation methods with centrifugal force such as differential centrifugation or density gradient centrifugation may be used.

For purification, a known method for protein purification may be used. The method comprises a step of crudely fractionating cells into polypeptide fractions and non-polypeptide fractions. After the γ-secretase or EphA4 of the present invention has been isolated from other polypeptides, the desired γ-secretase or EphA4 is further purified by chromatography or electrophoresis to thereby achieve partial purification or complete purification (or homogenization by purification). Examples of analysis methods particularly suitable for preparation/purification of pure peptides include precipitation using ammonium sulfate, PEG, antibodies, etc.; centrifugation after thermal denaturation; chromatography step (e.g., ion exchange chromatography, gel filtration chromatography, reversed-phase chromatography, hydroxyapatite chromatography, affinity chromatography, fast protein liquid chromatography (FPLC), high performance liquid chromatography (HPLC) or immobilized metal ion affinity chromatography (IMAC)); isoelectric focusing; gel electrophoresis; SDS (sodium dodecyl sulfate)-polyacrylamide electrophoresis (SDS-PAGE); and a combination of these methods and other method. Alternatively, γ-secretase or EphA4 may be tagged in advance; then, a crude polypeptide may be applied to a purification column to which a protein that recognizes the tag is bound; the desired γ-secretase or EphA4 adsorbed onto the column may be desorbed from the column by feeding an appropriate solvent thereinto. Various purification steps may be performed in a different order, or some of the steps may be omitted. A preferable method for evaluating the purity of a fraction is a method in which the specific activity of the fraction is calculated and compared with the specific activity of the first extract, followed by calculation of the magnitude of purity for evaluation.

As used herein, the term "intracellular EphA4 cleaved by γ-secretase" refers to one of the following:

a) the EphA4 fragment on the intracellular domain side (EphA4 intracellular domain), said fragment being one of the two fragments produced by processing the above-described EphA4 with the above-described γ-secretase; or b) a polypeptide comprising an amino acid sequence substantially identical with the amino acid sequence of the above-mentioned fragment.

Hereinafter, the "intracellular EphA4 cleaved by γ-secretase" is sometimes simply referred to as "intracellular EphA4".

The term "APP" used herein means β-amyloid precursor protein (βAPP) or a mutant thereof. APP is a single-pass transmembrane protein comprising an Aβ domain in its C-terminal region, expressed in a large variety of cells in many mammals. In human, APP is encoded by the gene APP located in the long arm of chromosome No. 21 and has three major isotypes (APP695, APP751 and APP770). APP695, APP751 and APP770 consist of 695, 751 and 770 amino acid residues, respectively. Examples of APP proteins include human APP695 (NM_201414, NP_958817 and P05067-4), human APP751 (NM_201413, NP_958816 and P05067-8), human APP770 (NM_000484, NP_000475, P05067-1 and P05067), mouse APP695 (NM_007471, NP_031497 and P12023-2), mouse APP751 (P12023-3), mouse APP770 (AY267348, AAP23169, P12023-1 and P12023), rat APP695 (P08592-2), rat APP751 (P08592-7) and rat APP770 (NM_019288, NP_062161, P08592-1 and P08592). Examples of APP mutants include Swedish FAD double mutant, London mutant, valine717 to phenylalanine mutant, valine717 to isoleucine mutant and valine717 to glycine mutant.

The term "Aβ" used herein means the term β-amyloid protein, amyloid β protein, β-amyloid peptide, amyloid β peptide or amyloid beta. For example, Aβ is a peptide consisting of about 33-40 amino acids residues in human APP695 amino acid isotype. Preferably, Aβ includes any peptide comprising a part or all of the amino acid residues from positions 597 to 640 in APP, and means every peptide produced from APP by its N-terminal protein degradation and subsequent C-terminal protein degradation. Aβ40 and Aβ42 are peptides comprising 40 amino acid residues and 42 amino acid residues, respectively.

The term "Notch" used herein refers to one of the competing substrates for γ-secretase belonging to the cell surface receptor. For example, human Notch 1 (AF308602.1), mouse Notch 1 (NM_008714.2) and rat Notch 1 (NM_001105721.1) may be enumerated. Since Notch 1 has an important function in hematopoiesis, inhibition of the processing of Notch 1 may potentially cause immunodeficiency and anemia.

The term "compound" used herein means any molecule capable of changing the activity of γ-secretase (preferably the activity of γ-secretase of mammals). The compound is one or more compounds contained in expression products of gene libraries; natural or synthetic low molecular weight compound libraries; nucleic acids (oligo DNA or oligo RNA); natural or synthetic peptide libraries; antibodies; substances released from bacteria (including those released from bacteria as a result of metabolism); cell (microorganisms, plant cells or animal cells) extracts; cell (microorganism, plant cell or animal cell) culture supernatants; purified or partially purified peptides; extracts from marine organisms, plants or animals; soils; or random phage peptide display libraries. The above-described compound may be either a novel compound or a known compound. Further, the above-described compound may be a compound modified by conventional chemical means, physical means and/or biochemical means. For example, the above-described compound may be a structural analogue which is obtained by subjecting the initial compound to direct chemical modification (such as acylation, alkylation, esterification or amidation) or random chemical modification. The candidate compound may also be a compound identified by pharmacophore search of the above-described compound or structure comparison programs with computer. The candidate compound may be in the form of a salt. Further, the candidate compound or a salt thereof may be in the form of a solvate (including hydrate).

Further, the compound may be a known γ-secretase accelerator or γ-secretase inhibitor involved in the processing of APP and/or the processing of Notch, or a structural analogue of the above accelerator or inhibitor. A compound which accelerates or inhibits the activity of γ-secretase and/or the processing of APP and/or the processing of Notch may be a compound that can be designed through rational drug design. Examples of such compounds include DAPT (N—[N-(3,5-difluorophenacetyl)-L-alanyl]-S-phenylglycine t-butyl ester), CM256 (N-[(1,1dimethylethoxy)carbonyl]-L-valyl-(4S,5S)-4-amino-2,2-difluoro-5-methyl-3-oxoheptanoyl-L-valyl-L-lsoleucine methyl ester) and (2S)-2-{[(3,5-Difluorophenyl)acetyl]amino}-N-[(3S)-1-methyl-2-oxo-5-phenyl-2,3-dihydro-1H-1,4-benzodiazepin-3-yl]propanamide (Alexis Biochemicals).

The expression "compound which affects the processing of EphA4 by γ-secretase" used herein refers to either a compound which inhibits the EphA4 cleavage activity by γ-secretase (γ-secretase inhibitor) or a compound which accelerates the EphA4 cleavage activity by γ-secretase (γ-secretase accelerator). The γ-secretase inhibitor includes antagonists, and the γ-secretase accelerator includes agonists. The γ-secretase inhibitor and the γ-secretase accelerator also include compounds which alter the cleavage site of EphA4 cleavage product by γ-secretase to thereby produce EphA4 cleavage products with different peptide lengths.

The expression "compound which affects spine formation by γ-secretase-processed EphA4" used herein refers to either a compound which promotes spine formation activity through intracellular EphA4 cleaved by γ-secretase (sometimes expressed as "γ-secretase-cleaved intracellular EphA4") or a compound which inhibits spine formation activity through γ-secretase-cleaved intracellular EphA4. Examples of compounds which promote or inhibit spine formation activity through γ-secretase-cleaved EphA4 include those compounds which inhibit or promote the degradation of γ-secretase-cleaved EphA4. It is known that EphA4 binds to a substance involved in the ubiquitin pathway in cells. A compound which inhibits this binding can be a compound that promotes the spine formation activity by γ-secretase-cleaved EphA4.

The expression "compound which affects Rac activity mediated by γ-secretase-processed EphA4" used herein refers to either a compound which activates Rac through γ-secretase-cleaved intracellular EphA4 or a compound which inhibits Rac through γ-secretase-cleaved intracellular EphA4.

The term "salt" used herein refers to a pharmacologically acceptable salt, and is not particularly limited as long as it is forming a pharmacologically acceptable salt with the above-described compound. Preferred examples thereof are hydrohalogenic acid salts (such as hydrofluoride, hydrochloride, hydrobromide or hydroiodide), inorganic acid salts (such as sulfate, nitrate, perchlorate, phosphate, carbonate or hydrogencarbonate), organic carboxylic acid salts (such as acetate, oxalate, maleate, tartrate, fumarate or citrate), organic sulfonic acid salts (such as methanesulfonate, trifluoromethanesulfonate, ethanesulfonate, benzenesulfonate, toluenesulfonate or camphorsulfonate), amino acid salts (such as aspartate or glutamate), quaternary amine salts, alkali metal salts (such as lithium salt, sodium salt or potassium salt) and alkaline earth metal salts (such as magnesium salt or calcium salt).

The term "spine" used herein refers to a microstructure constituting chemical synapses which is a spiny protuberance formed on dendrites at postsynaptic sites (dendritic spine) (see Hering et al., Nat Rev Neurosci. 2001 December; 2(12): 880-8). Generally, two types of synapses (dendritic filopodia and dendritic spine) exist in mature brains. It is proposed that spine is involved in the processes of memory and learning through shifting from dendritic filopodia to dendritic spine when memorizing or learning is performed.

The term "treatment" used herein generally means obtaining a desired pharmacological and/or physiological effect. The effect may be prophylactic in terms of completely or partially preventing a disease and/or a symptom and may be therapeutic in terms of partially or completely curing a disease and/or an adverse effect attributed to the disease. The term "treatment" as used herein covers any treatment of a disease in a patient, preferably a human, and includes at least one treatment selected from the following (a) to (c):

(a) preventing a disease or a symptom from occurring in a patient who may be predisposed to the disease but has not yet been diagnosed as having it;

(b) inhibiting a disease symptom, i.e. preventing or delaying its progress; or (c) relieving a disease symptom, i.e. causing regression or elimination of the disease or symptom, or causing reversal of the progress of the disease.

For example, as clinical symptoms of AD, progressive disorientation, memory loss and aphasia are enumerated. Finally, disablement, speech loss and akinesia occur. Pathological signs of AD include neurofibrillary tangle, senile plaques and amyloid angiopathy. To prevent the progress of AD is interpreted to mean to prevent the onset or further progress of the clinical symptoms and/or pathological signs of AD. For example, in patients who do not have the clinical symptoms or pathological signs of AD, it is possible to prevent the progress of clinical symptoms or pathological signs. In patients suffering from mild AD, it is possible to prevent the development of more severe AD forms. To delay the progress of AD is interpreted to mean to delay the point of onset of AD-related symptoms and/or pathological signs, or to reduce the speed of progress of AD that is determined by the speed of progress of clinical symptoms and pathological signs. To reverse the progress of AD is interpreted to mean to relieve the severity of AD symptoms, i.e., to change the severity of AD conditions of patients from severe to mild. At that time, the change to mild is indicated by decrease of clinical symptoms or pathological signs.

Diagnosis of AD in patients may be performed by various known methods. Typically, AD is diagnosed by combining clinical and pathological assessments. For example, the progress or severity of AD may be judged using Mini Mental State Examination (MMSE) (Mohs et al. (1996) Int Psychogeriatr 8: 195-203), Alzheimer's Disease Assessment Scale-Cognitive Subscale (ADAS-cog) (Galasko et al., (1997) Alzheimer Dis Assoc Disord, 11 suppl 2: S33-9), Alzheimer's Disease Cooperative Study-Activities of Daily Living (ADCS-ADL) (McKhann et al., (1984) Neurology 34: 939-944) and Criteria of National Institute of Neurologic Communicative Disorders and Stroke-Alzheimer's Disease and Related Disorders Association (NINCDS-ADRDA) (Folstein et al., (1975) J Psychiatr Res 12: 189-198; McKhann et al., (1984) Neurology 34: 939-944). Further, methods which evaluate various regions of the brain and enable the estimation of frequency of senile plaques or neurofibrillary tangle may be used (Braak et al., (1991) Acta Neuropathol 82: 239-259; Khachaturian (1985) Arch Neuro 42: 1097-1105; Mirra et al., (1991) Neurology 41: 479-486; and Mirra et al., (1993) Arch Pathol Lab Med 117: 132-144).

According to the present invention, there are provided, as the first embodiment, an assay method for examining the cleavage of EphA4 and a method of secondarily evaluating whether or not a candidate compound is a compound which affects γ-secretase utilizing the assay method (screening method). In the first embodiment, the method as described below is provided. The method of this embodiment is characterized by the use of EphA4, a novel substrate for γ-secretase. The method of this embodiment may be performed in an appropriate cell system or a cell-free system. The method of this embodiment is capable of evaluating the cleavage of EphA4 by γ-secretase by incubating EphA4 and γ-secretase in the presence and absence of a candidate compound.

The method of screening for compounds which affect the processing of EphA4 by γ-secretase (which is the first embodiment of the present invention) comprises the following steps:

(i) contacting a first biological composition containing γ-secretase or a biologically active fragment thereof with a second biological composition containing EphA4 in the presence and absence of a candidate compound;

(ii) measuring the cleavage of the EphA4 in the presence and absence of the candidate compound;

(iii) selecting those candidate compounds which affect the cleavage of the EphA4 by γ-secretase; and (iv) identifying the candidate compounds selected in step (iii) as compounds which affect the processing of EphA4 by γ-secretase.

The method of this embodiment may be performed in an appropriate cell system containing γ-secretase and EphA4 or a cell-free system containing γ-secretase and EphA4. The cell system containing γ-secretase and EphA4 may be either a cell system expressing endogenous genes or a cell system containing exogenous genes. It is possible to culture a cell containing γ-secretase and EphA4 in an appropriate medium in the presence and absence of a candidate compound and incubate the cell under reaction conditions which allow the cleavage of EphA4 by γ-secretase activity. When a cell system containing exogenous genes is used, the cell may be cultured under conditions which allow the expression of the exogenous genes. It is also possible to apply conditions that allow the cleavage of other γ-secretase substrate, e.g., reaction conditions known to those skilled in the art when the substrate is APP. For cell systems expressing endogenous genes, in the case of primary culture of neurons, examples of culture conditions are MEM (Invitrogen) medium supplemented with 5% FBS (Hyclone), 1X B27 Supplement (Invitrogen), 0.5 mM L-glutamine (Invitrogen), 25 µg/ml insulin (SIGMA) and 8 µM AraC(SIGMA); under 5% $CO_2$; and at 37° C. For cell systems containing exogenous genes, in the case of HEK293 cell strain, examples of culture conditions are 10% FBS (Hyclone)/DMEM (Invitrogen), under 5% $CO_2$ and at 37° C. In a cell-free systems, a first biological composition containing γ-secretase or a biologically active fragment thereof (e.g., cell membrane fraction containing γ-secretase) and a second biological composition containing EphA4 (e.g., cell membrane fraction containing EphA4) may be incubated in the presence and absence of a candidate compound by mixing these compositions with each other. These compositions may be mixed under reaction conditions which allow the cleavage of EphA4 by γ-secretase activity, e.g., 10 mM HEPES, pH 7.4, 150 mM NaCl, 10% glycerol, 5 mM EDTA, 5 mM 1,10-phenanthroline, 10 µg/ml phosphoramidon, Complete protease inhibitor cocktail (Roche Biochemicals) (Tomita et al., Molecular Neurodegeneration 2006 1:2). Alternatively, these compositions may be mixed under conditions which allow the cleavage of other γ-secretase substrate, e.g., reaction conditions known to those skilled in the art when the substrate is APP. γ-Secretase or EphA4 may be a purified γ-secretase or EphA4, a biologically active fragment of γ-secretase or EphA4, an analogue of γ-secretase or EphA4, or a mutant of γ-secretase or EphA4.

The candidate compound may be added generally within a range from approx. 1 nM to 1 mM, usually within a range from approx. 10 µM to 1 mM. In order to identify a modulator which changes the EphA4 cleavage activity of γ-secretase, the steps described above are performed in the presence and absence of a candidate compound. Then, the EphA4 cleavage activity of γ-secretase in the presence of the candidate compound is compared with that activity in the absence of the candidate compound to evaluate the ability of the candidate compound. Thus, a compound which changes the cleavage of EphA4 by γ-secretase is identified. Even a slight change in the quantity or degree of cleavage of EphA4 in the presence of a candidate compound indicates that the EphA4 cleavage activity of γ-secretase has been changed in the presence of the candidate compound; this means that a compound which is a modulator of γ-secretase activity has been identified. For example, a compound which increases EphA4 cleavage product compared with control is evaluated as an accelerator for the protein degradation activity of γ-secretase. On the other hand, a compound which decreases EphA4 cleavage product compared with control is evaluated as an inhibitor for the protein degradation activity of γ-secretase. The accelerator or modulator for γ-secretase obtainable by the method of the present invention is potentially useful for treatment of AD. The inhibitor for γ-secretase obtainable by the method of the present invention is potentially useful for treatment of diseases accompanied by synaptic hyperplasia (especially, hyperplasia of spine).

When EphA4 is tagged, it is possible to detect the product of EphA4 using a substance which binds to the tag (e.g., antibody). For example, EphA4 with a hemagglutinin tag added to its C-terminus may be detected using a known anti-HA antibody.

Analysis of EphA4 cleavage is performed by measuring an indicator of cleavage for one or both of the N-terminal fragment and C-terminal fragment of EphA4. For analyzing the cleavage of EphA4 by γ-secretase, the following antibodies may be used: anti-EphA4 antibodies or antibodies that recognize EphA4 cleavage product produced as a result of cleavage of EphA4, preferably antibodies that recognize the intracellular domain of EphA4. When a cleaved product of tagged EphA4 polypeptide is to be detected, an antibody to the selected tag may be used. For example, when an HA tag has been added to the C-terminus of EphA4, an anti-HA tag antibody may be used for detection. In this case, it is possible to clarify the presence and concentration of a C-terminal fragment of EphA4 produced as a result of EphA4 cleavage. When EphA4 or tagged EphA4 is labeled, quenched state of the label may be detected.

The antibody to EphA4 is not particularly limited as long as the antibody recognizes EphA4. Preferably, an antibody which recognizes the intracellular domain of EphA4 is used. For example, the antibody described in Tremblay et al., J. Comp. Neurol 501 691-702 or a commercial anti-rat EphA4 antibody (Upstate, Zymed or Santacruze) may be used. Those skilled in the art could prepare such an antibody by immunizing an animal with an immunogen (antigen) and following the conventional, general procedures for preparing monoclonal antibodies. For example, a non-human mammal is immunized with the immunogen alone or, if necessary, together with Freund's adjuvant. Polyclonal antibodies may be obtained from the serum collected from the immunized animal. Monoclonal antibodies may be obtained by fusing antibody producing cells from the immunized animal with myeloma cells without autoantibody producing ability to prepare fusion cells (hybridomas), cloning the hybridomas, and selecting those clones which produce a monoclonal antibody showing specific affinity to the antigen used for immunizing the animal. The preparation of monoclonal antibodies from hybridomas may be performed in vitro. Alternatively, the preparation may be performed in vivo in a non-human mammal, preferably mouse or rat, more preferably in the abdominal dropsy in mouse. Monoclonal antibodies may be isolated from the resultant culture supernatant or the abdominal dropsy of the mammal. The isolation and purification of monoclonal antibodies may be performed by subjecting the above-mentioned culture supernatant or abdominal dropsy to methods such as saturated ammonium sulfate precipitation, euglobulin precipitation, caproic acid method, caprilic acid method, ion exchange chromatography (DEAE, DE52, etc.), or affinity column chromatography using anti-immunoglobulin column or protein A column. The monoclonal antibody include those monoclonal antibodies consisting of heavy chains and/or light chains having the amino acid sequences which have deletion, substitution or addition of one or several amino acids in the heavy chains and/or light chains constituting the initial antibody.

In another embodiment of the present invention, it is possible to evaluate whether or not a candidate compound affects the processing of APP and/or Notch in parallel with, simultaneously with, or before or after the above-described method of the first embodiment. For example, a step of measuring the cleavage of APP or a polypeptide containing APP γ-secretase cleavage site may be included in parallel with, simultaneously with, or before or after the above-described method of the first embodiment. Further, a step of measuring the cleavage of Notch or a polypeptide containing Notch γ-secretase cleavage site may be included. By including such steps, it is possible to evaluate whether or not a candidate compound selectively acts on the processing of EphA4 compared to the processing of APP and/or Notch. Specifically, it is possible to identify compounds which selectively act only on the processing of EphA4; compounds which selectively act only on the processing of APP; compounds which selectively act only on the processing of Notch; compounds which selectively act on the processing of APP and EphA4; compounds which selectively act on the processing of Notch and EphA4; or compounds which selectively act on the processing of APP, Notch and EphA4.

As candidate compounds for drug development, compounds which act in the same manner as metabolic activity in healthy animals in vivo or compounds which regulate the metabolic activity are preferable. A non-restrictive preferable example is a compound which inhibits the production of Aβ42 by inhibiting the APP cleavage activity of γ-secretase, does not inhibit the EphA4 cleavage activity of γ-secretase, and does not inhibit the Notch cleavage activity of γ-secretase. Another non-restrictive preferable example is a compound which inhibits the production of Aβ42 by accelerating the production of Aβ40 through acceleration of the APP cleavage activity of γ-secretase, accelerates the processing of EphA4 by accelerating the EphA4 cleavage activity of γ-secretase, and does not inhibit the Notch cleavage activity of γ-secretase.

As methods for measuring the cleavage by γ-secretase of APP, Notch or a polypeptide containing an APP or Notch γ-secretase cleavage site, assay methods known to those skilled in the art may be applicable (Song et al. PNAS 1999 96 6959-6963; Moehlmann et al. PNAS 2002 99 8025-8030). For example, a first biological composition containing γ-secretase or a biologically active fragment thereof may be contacted with a biological composition containing APP or a polypeptide containing an APP γ-secretase cleavage site or a biological composition containing Notch or a polypeptide containing a Notch γ-secretase cleavage site in the presence and absence of a candidate compound, and then the cleavage of the APP or the polypeptide containing an APP γ-secretase cleavage site or the cleavage of the Notch or the polypeptide containing a Notch γ-secretase cleavage site may be measured. This measurement may be performed by measuring the cleavage product from the APP or the polypeptide containing an APP γ-secretase cleavage site or the cleavage product from the Notch or the polypeptide containing a Notch γ-secretase cleavage site. As one example of the cleavage product from APP or a polypeptide containing an APP γ-secretase cleavage site, Aβ may be given. The quantity of Aβ may be measured, and changes in the quantity between the presence and absence of the candidate compound may be compared. Alternatively, the degree of cleavage and the quantity of cleavage product may be measured by using a known antibody which recognizes the cleavage product from APP or a polypeptide containing an APP γ-secretase cleavage site or the cleavage product from Notch or a polypeptide containing a Notch γ-secretase cleavage site. As the antibody which recognizes the cleavage product from APP or a polypeptide containing an APP γ-secretase cleavage site, commercial antibodies (Sigma or Chemicon) may be used. The measurement may be performed, for example, by Western blotting. As the antibody which recognizes the cleavage product from Notch or a polypeptide containing a Notch γ-secretase cleavage site, commercial antibodies (Santacruze) may be used. The measurement may be performed, for example, by Western blotting.

This embodiment includes a method of evaluating the morphology of postsynapses or the function of neurotransmission using those compounds which are identified by the above-described method of this embodiment. For example, the evaluation of the morphology of postsynapses is carried out by evaluating the number and the shape of spines (Pak D et al. Neuron 2001 31:289-303). The evaluation of the function of neurotransmission is carried out, for example, by evaluating electrical changes occurring on the synapse membrane using cultured cells or cultured slices (Saura et al., Neuron 2004 42: 23-36).

The method of this embodiment also includes a high through put screening (HTS) known to those skilled in the art, which tests a large number of compounds simultaneously (U.S. Pat. No. 5,876,946; U.S. Pat. No. 5,902,732; Jayawickreme and Kost, Curr. Opin. Biotechnol., 8, pp. 629-634, 1997; Houston and Banks, Curr. Opin. Biotechnol., 8, pp. 734-740, 1997).

The method of this embodiment also includes the use of known model animals. It is possible to analyze the in vivo effect of a compound selected by the in vitro method of the present invention by using, for example, an APP processing and/or AD non-human model. APP transgenic non-human animal models are well-known in the art. One example thereof is Tg2576 mouse (J. Neurosci. 21(2), 372-381, 2001; J. Clin. Invest., 112, 440-449, 2003). For example, the following analyses may be made after administering to Tg2576 mouse a known γ-secretase inhibitor DAPT, (2S)-2-{[(3,5-difluorophenyl)acetyl]amino}-N-[(3S)-1-methyl-2-oxo-5-phenyl-2,3-dihydro-1H-1,4-benzodiazepin-3-yl]propanamide (Alexis Biochemicals) or a compound of the present invention: evaluation by a method of measuring the Aβ quantities in the brain, cerebrospinal fluid and serum of the mouse (J. Pharmacol. Exp. Ther. 305, 864-871, 2003); pathological examination of changes in the brain (e.g., changes in Aβ yield, the degree of cerebral atrophy, etc.) resulted from changes in γ-secretase activity; and evaluation of the survival ratio, momentum or food consumption of the mouse.

According to the method of the present invention, there are provided, as the second and third embodiments, a method of secondary evaluation of whether or not a compound affects γ-secretase (screening method) and a method of secondary evaluation of whether or not a compound affects spine formation (screening method), wherein both screening methods use the above-mentioned method of evaluating the morphology of postsynapses or the function of neurotransmission. In the second and third embodiments, the methods described below are provided.

The method of the second embodiment is also characterized by the use of EphA4 as in the method of the first embodiment. The method of the second embodiment may be performed in an appropriate cell system.

The method of the second embodiment is capable of evaluating spine formation by incubating γ-secretase and EphA4 in the presence or absence of a candidate compound and then measuring the number of spines in spine forming cells.

The screening method of the second embodiment comprises the following steps:

(i) contacting γ-secretase with EphA4 in the presence and absence of a candidate compound;

(ii) measuring the number of spines in spine forming cells in the presence and absence of the candidate compound;

(iii) selecting those candidate compounds which affect the number of spines based on the number of spines measured in step (ii); and (iv) identifying the candidate compounds selected in step (iii) as compounds which affect the processing of EphA4 by γ-secretase.

The method of the second embodiment may be performed in a cell system where it is possible to observe the process of spine formation through intracellular signaling resulted from the contact of γ-secretase and EphA4. The method of the second embodiment may be performed in the "appropriate cell system containing γ-secretase and EphA4" in the first embodiment and a cell system containing spine forming cells. It should be noted here that the "appropriate cell system containing γ-secretase and EphA4" and the spine forming cell may be different cells or the same cell. The term "spine forming cell" refers to a cell capable of forming spines. For example, neurons with excitatory synapses in the central nervous system may be given.

Examples of preferable cell systems in this embodiment include primary cultured neurons and brain slice cultured cells. Primary cultured neurons may be obtained in the same manner as described in Example 2. Brain slice cultured cells may be obtained as described below.

The total brain is removed from postnatal 8 to 9 day-old rats and placed in a beaker containing GBSS solution (UBSS (SIGMA)/MEM (Invitrogen)/Horse serum (SIGMA)=1:2:1) for cooling for about 1 minute. After the cooling, the total brain is transferred from the beaker to a stage, and then the cerebellum and the rostral half of the cerebrum are cut off. The remaining brain is fixed on the stage with an adhesive. The hippocampus is cut out from the fixed tissue section. The resultant section (300-400 μm) is placed on a membrane on wells prepared in advance and cultured thereon. Primary cultured cells thus obtained may be used (see Stoppini, L., Buchs, P.-A. and Muller, D. J. Neurosci. Methods. 37 (1991) 173-182; Gahwiler, B. H. Trends Neurosci. 11 (1988) 484-489; Sakaguti, T., Okada, M. and Kawasaki, K. Neurosci. Res. 20 (1994) 157-164).

The spines to be measured in the second embodiment are spines on synapses at the stage of dendritic filopodia and/or dendritic spine, preferably spines on synapses at the stages of dendritic filopodia and dendritic spine. Synapses at the stages of dendritic filopodia and dendritic spine are those synapses of the morphology that exist when memorizing or learning is actually performed. By measuring spines on such synapses, it is possible to measure spines on those synapses which are in the state of functioning in vivo or those synapses which are at a stage just before functioning.

For measurement of the number of spines, it is possible to detect spines by using an antibody that recognizes a molecule expressed specifically in spines, or by using an antibody capable of recognizing a polypeptide in which a molecule expressed specifically in spines has been tagged, or by using a spine forming cell in which the cell per se has been labeled.

When a spine forming cell which has been labeled is used, detection of spines is performed by searching for thorn-like protuberances on the spine forming cell with a microscope capable of detecting the label. As the label, EGFP may be used.

When an antibody that recognizes a molecule expressed specifically in spines is used, examples of such antibodies include anti-PSD-95 (Postsynaptic Density-95) antibody, anti-Glutamate Receptor1 antibody, anti-actin antibody, anti-Homer antibody and anti-Shank antibody.

When a polypeptide in which a molecule expressed specifically in spines has been tagged is detected, an antibody to the selected tag may be used. When PSD-95 is selected as a molecule expressed specifically in spines and added an EGFP tag at its C-terminus, this molecule may be detected by using anti-EGFP tag antibody. In this case, it is possible to clarify the existence and concentration of the C-terminal fragment of PSD-95.

In order to identify modulators which change the EphA4 cleavage activity of γ-secretase, each of the steps described above is carried out in the presence and absence of a candidate compound, and then the spine formation activity in the presence of the candidate compound is compared with the spine formation activity in the absence of the candidate compound. Thus, the ability of the candidate compound is evaluated to thereby identify those compounds which change the EphA4 cleavage by γ-secretase. Even a slight change in the number of spines in the presence of a candidate compound indicates that the EphA4 cleavage activity of γ-secretase has been changed in the presence of the candidate compound. This means that a compound which will be a modulator for γ-secretase activity has been identified. For example, a compound which increases the number of spines compared with control is evaluated as a modulator for the protein degradation activity of γ-secretase or an accelerator for the protein degradation activity of γ-secretase. On the other hand, a compound which decreases the number of spines compared with control is evaluated as a modulator for the protein degradation inhibitory activity of γ-secretase or an inhibitor for the protein degradation activity of γ-secretase.

In Aβ42 which has been believed to be the major cause of Alzheimer's disease, a plurality of peptides exist which are different in length depending on the cleavage site by γ-secretase. Since these peptides do not easily form the α-sheet structure that generates cytotoxicity, it is considered that, naturally, APP is cleaved by γ-secretase at an appropriate site in bodies of healthy animals and that Aβ42 is a product generated as a result of cleavage by γ-secretase at an inappropriate site. For the treatment of dementia including AD, it is believed that an accelerator for the protein processing activity of γ-secretase which cleaves APP at an appropriate site is useful.

Therefore, the accelerator for the protein processing activity of γ-secretase obtainable by the method of the present invention is potentially useful for the treatment of dementia, especially AD.

On the other hand, for the treatment of diseases accompanied by excessive formation of synapses, especially spines, it is believed that an inhibitor for the protein processing activity of γ-secretase is useful. The inhibitor for the protein degradation activity of γ-secretase obtainable by the method of the present invention is potentially useful for the treatment of those diseases.

For those terms used in the second embodiment and not particularly explained, the same terms used in the first embodiment may be appropriately referred to.

The method of the third embodiment is characterized by the use of intracellular EphA4 processed (cleaved) by γ-secretase. The method of the third embodiment may be performed in an appropriate cell system. The method of the third embodiment is capable of evaluating spine formation by measuring the number of spines in cells before and after the expression of intracellular EphA4.

The screening method (which is the third embodiment of the present invention) comprises the following steps:

(i) culturing spine forming cells which have expressed intracellular EphA4 cleaved by γ-secretase;

(ii) measuring the number of spines in the spine forming cells cultured in step (i) in the presence and absence of a candidate compound;

(iii) selecting those candidate compounds which affect the number of spines based on the number of spines measured in step (ii); and (iv) identifying the candidate compounds selected in step (iii) as compounds which affect the spine formation by γ-secretase-processed EphA4.

The method of the third embodiment may be performed in a cell system where it is possible to observe the process of spine formation through intracellular signaling mediated by the presence of intracellular EphA4 cleaved by γ-secretase. The appropriate cell system for this method is not limited to those cell systems used in the second embodiment. Any cell system may be used as long as it contains cells which perform spine formation through the expression of EphA4 intracellular fragment cleaved by γ-secretase.

The cells which have expressed intracellular EphA4 cleaved by γ-secretase mean the following (a) or (b), or include both (a) and (b):

(a) the expression of intracellular EphA4 is derived from an exogenous gene, and the above-mentioned cells are composed of cells before the expression of intracellular EphA4 cleaved by γ-secretase and cells after that expression;

(b) the expression of intracellular EphA4 is derived from an endogenous gene, and the above-mentioned cells are composed of cells before the expression of intracellular EphA4 cleaved by γ-secretase and cells after that expression.

When the intracellular EphA4 cleaved by γ-secretase is derived from an exogenous gene, the seventh embodiment of the present invention described later is applicable to the intracellular EphA4, and the method may be performed under culture conditions which allow the expression of the gene or under culture conditions which allow spine formation. In the case of primarily cultured neurons, they may be cultured under the following conditions, for example: MEM (Invitrogen) medium supplemented with 5% FBS (Hyclone), 1X B27 Supplement (Invitrogen), 0.5 mM L-glutamine (Invitrogen), 25 µg/ml insulin (SIGMA) and 8 µM AraC (SIGMA), 5% $CO_2$, 37° C. In the case of HE 93 cell strain, cells may be cultured under the following conditions, for example: 10% FBS (Hyclone)/DMEM (Invitrogen), 5% $CO_2$, 37° C.

When the intracellular EphA4 cleaved by γ-secretase is derived from an endogenous gene, conditions which allow the cleavage of EphA4 by γ-secretase or conditions which allow spine formation may be examined. Then, cells before and after the cleavage of EphA4 or cells before and after spine formation may be used as the cells before and after the expression of intracellular EphA4 cleaved by γ-secretase.

The spines to be measured and the method of measurement are the same as described in the second embodiment.

In order to identify modulators which change the spine formation activity by intracellular EphA4 cleaved by γ-secretase, each of the steps described above is carried out in the presence and absence of a candidate compound, and then the spine formation activity after the expression of intracellular EphA4 cleaved by γ-secretase is compared with the spine formation activity before the expression of intracellular EphA4 cleaved by γ-secretase. Thus, the ability of the candidate compound is evaluated to thereby identify those compounds which change the spine formation activity by intracellular EphA4 cleaved by γ-secretase. Even a slight change in the number of spines before and after the expression of intracellular EphA4 cleaved by γ-secretase indicates that the spine formation activity has been changed by intracellular EphA4 cleaved by γ-secretase. This means that a compound which will be a modulator for the activity of spine formation by intracellular EphA4 cleaved by γ-secretase has been identified. For example, a compound which increases the number of spines compared with control is evaluated as a spine formation accelerator. On the other hand, a compound which decreases the number of spines compared with control is evaluated as a spine formation inhibitor.

The spine formation accelerator may be a compound which inhibits the degradation of intracellular EphA4 cleaved by γ-secretase. Since a compound which inhibits the degradation of intracellular EphA4 cleaved by γ-secretase increases the effective quantity of intracellular EphA4 cleaved by γ-secretase, such a compound can be a compound which accelerates spine formation activity. Examples of compounds with such effect include compounds which inhibit the binding to those substances involved in the ubiquitin pathway in cells.

On the other hand, the spine formation inhibitor may be a compound which accelerates the degradation of intracellular EphA4 cleaved by γ-secretase. Since a compound which accelerates the degradation of intracellular EphA4 cleaved by γ-secretase decreases the effective quantity of intracellular EphA4 cleaved by γ-secretase, such a compound can be a compound which inhibits spine formation activity. Examples of compounds with such effect include compounds which accelerate the binding to those substances involved in the ubiquitin pathway in cells.

The spine formation accelerator obtainable by the method of the present invention is potentially useful for the treatment of dementia, especially AD.

On the other hand, the spine formation accelerator obtainable by the method of the present invention is potentially useful for the treatment of diseases accompanied by synaptic hyperplasia (especially, hyperplasia of spine).

For those terms used in the third embodiment and not particularly explained, the same terms used in the second embodiment described above may be appropriately referred to.

According to the method of the present invention, there are provided, as the fourth embodiment, an in vitro assay method for examining the cleavage site of EphA4 by γ-secretase and a method of secondary evaluation of whether or not a candidate compound is a compound which affects the processing of EphA4 by γ-secretase utilizing the assay method (screening method). In the fourth embodiment, the method as described below is provided. As the method of the first embodiment, the method of this embodiment is also characterized by the use of EphA4. The method of this embodiment may be performed in an appropriate cell system or a cell-free system. The method of this embodiment is capable of evaluating the regulation of cleavage site of EphA4 by γ-secretase by incubating EphA4 and γ-secretase in the presence and absence of a candidate compound.

The method of screening for compounds which affect the processing of EphA4 by γ-secretase (which is the fourth embodiment of the present invention) comprises the following steps:

(i) contacting a first biological composition containing γ-secretase or a biologically active fragment thereof with a second biological composition containing EphA4 in the presence of a candidate compound;

(ii) recovering the second biological composition containing intracellular EphA4 cleaved by γ-secretase;

(iii) identifying the amino acid sequence of the biological composition recovered in step (ii); and (iv) identifying the candidate compound as a compound which regulates the cleavage site of EphA4 when the amino acid sequence identified in step (iii) is different from the amino acid sequence of EphA4 contacted with γ-secretase as set forth in step (i) in the absence of said candidate compound.

The method of this embodiment may be performed in "an appropriate cell system containing γ-secretase and EphA4 or a cell-free system" used in the first embodiment. Examples of preferable EphA4 in this embodiment include fusion polypeptides, tagged or labeled polypeptides, and otherwise modified polypeptide described in the first embodiment. More preferably, a polypeptide in which a tag is added to EphA4 on the intracellular domain side may be used. Preferable examples of such polypeptides include tagged rat intracellular EphA4. For example, a polypeptide in which an HA tag has been added at the C-terminus of rat intracellular EphA4 (SEQ ID NO: 94) may be given. It is for granted that the full-length or a part of tagged intracellular EphA4 sequence derived from an animal other than rat (preferably human) (e.g., the amino acid sequence of SEQ ID NO: 100) may also be used in the same manner as a tagged rat EphA4.

Specifically, each of the steps described above is carried out in the presence of a candidate compound, and then the tagged EphA4 sequence cleaved by γ-secretase in the presence of the candidate compound is compared with the corresponding sequence in the absence of the candidate compound. Thus, the site of cleavage of EphA4 by γ-secretase is evaluated to thereby identify that the candidate compound is a compound which regulates the site of cleavage of EphA4 by γ-secretase. The above-described steps are performed with a plurality of candidate compounds. When the resultant sequences of tagged EphA4 are different among a plurality of compounds identified, this means that EphA4 degradation products by γ-secretase with different amino acid sequences have been obtained. That is, a plurality of compounds which regulate the site of cleavage of EphA4 by γ-secretase have been identified.

The regulator for the cleavage site by γ-secretase obtainable by the method of the present invention is potentially useful for the treatment of dementia, especially AD.

The second biological composition containing EphA4 may be detected by using a substance which binds to the selected tag (e.g., antibody). When an HA tag has been added to the C-terminus of EphA4, detection may be performed with an anti-HA tag antibody. The biological composition may be recovered by immunoprecipitation or Western blotting using the tag.

Techniques for identifying amino acid sequences are not particularly limited. Any technique well known to those skilled in the art may be used. Preferably, identification of amino acid sequences is performed using mass spectrometry.

Mass spectrometry of the recovered second biological composition containing EphA4 may be performed after purification of the recovered composition utilizing, for example, binding to the tag and, preferably, treatment with protease after the purification. The purification, protease treatment and mass spectrometry may be performed using known methods and devices appropriately.

In the determination of the amino acid sequence of the biological composition which has been subjected to mass spectrometry, the sequence of EphA4 cleaved by γ-secretase is determined based on the sequence of EphA4 and the molecular weight obtained by mass spectroscopy. As a result, the site of cleavage of EphA4 by γ-secretase is also determined.

In the identification of whether or not a candidate compound is a compound which regulates the cleavage site of EphA4, the candidate compound is identified as a compound which regulates the cleavage site of EphA4 when the amino acid sequence of EphA4 in the absence of the candidate compound is different from the amino acid sequence of the biological composition that was subjected to mass spectrometry.

In parallel with, simultaneously with, or before or after the above-described method of this embodiment, it is possible to evaluate whether or not a candidate compound affects the processing of APP and/or Notch. For example, a step of measuring the cleavage of APP or a polypeptide containing APP γ-secretase cleavage site may be included in parallel with, simultaneously with, or before or after the above-described method of this embodiment. Further, a step of measuring the cleavage of Notch or a polypeptide containing Notch γ-secretase cleavage site may be included. By including such steps, it is possible to evaluate whether or not a candidate compound selectively acts on the processing of EphA4 compared to the processing of APP and/or Notch.

The thus identified compounds which regulate the site of cleavage of EphA4 by γ-secretase are preferably compounds which induce spine formation in vitro; preferably, they are compounds which improve memory in vivo.

This embodiment also includes a method of evaluating the morphology of postsynapses or the function of neurotransmission by using compounds identified by the method of this embodiment.

The method of this embodiment also includes a high through put screening (HTS) known to those skilled in the art, which tests a large number of compounds simultaneously.

The method of this embodiment also includes the use of known model animals. It is possible to analyze the in vivo effect of a compound selected by the in vitro method of the present invention by using, for example, an AD non-human model.

For those terms used in the fourth embodiment and not particularly explained, the same terms used in the first embodiment described above may be appropriately referred to.

According to the present invention, there are provided, as the fifth and sixth embodiments, a method of secondary evaluation of whether or not a compound affects Rac activity (screening method) and a method of secondary evaluation of whether or not a compound affects spine formation (screening method), wherein both screening methods use a method of evaluating Rac activity. In the fifth and sixth embodiments, the methods described below are provided.

In the fifth embodiment, the method described below is provided. The method of this embodiment is also characterized by the use of intracellular EphA4 processed (cleaved) by γ-secretase as in the method of the third embodiment.

The method of the fifth embodiment is characterized by the use of intracellular EphA4 processed (cleaved) by γ-secretase. The method of the fifth embodiment may be performed in an appropriate cell system. The method of this embodiment is capable of evaluating effect upon Rac activity by incubating Rac expressing cells which have expressed intracellular EphA4 and then measuring the Rac activity in the cells in the presence and absence of a candidate compound.

The screening method of the fifth embodiment comprises the following steps:

(i) culturing Rac expressing cells which have expressed intracellular EphA4 cleaved by γ-secretase;

(ii) measuring Rac activity in the Rac expressing cells cultured in step (i) in the presence and absence of a candidate compound;

(iii) selecting those candidate compounds which affect Rac activity based on the measuring in step (ii); and (iv) identifying the candidate compounds selected in step (iii) as compounds which affect Rac activity mediated by γ-secretase-processed EphA4.

The method of the fifth embodiment may be performed in a cell system where it is possible to observe the process of change in Rac activity through intracellular signaling mediated by the presence of intracellular EphA4 cleaved by γ-secretase. Any cell system may be used as long as it contains cells in which changes in Rac activity caused by expression of γ-secretase-cleaved EphA4 intracellular fragment can be observed. Like in other embodiments, the expression of γ-secretase-cleaved intracellular EphA4 may be derived from either an exogenous gene or an endogenous gene, or derived from both. Examples of preferable cell systems in this embodiment include Rac expressing cells into which a gene encoding γ-secretase-cleaved intracellular EphA4 has been transferred. Rac expressing cells are found in a group of adherent cells involved in the rearrangement of actin cytoskeleton. For example, fibroblasts are included in this group. Cell systems used in this embodiment may be cultured under conditions that allow the expression of the gene of γ-secretase-cleaved intracellular EphA4 and, at the same time, the activation of Rac. When a gene encoding γ-secretase-cleaved intracellular EphA4 has been transferred into NIH3T3 cells, the cells may be cultured, for example, in DMEM (Invitrogen) supplemented with 10% CBS (flow) and Antibiotic-Antimycotic (Invitrogen) under 5% $CO_2$ and at 37° C.

Rac activity to be measured in the fifth embodiment may be determined by observing the presence or absence of lamellipodia structure (this structure is known to be formed upon activation of Rac) or measuring its formation ratio with a microscope. Alternatively, Rac activity may be measured by a pull down assay using a polypeptide to which activated Rac is capable of binding specifically (e.g., Rac binding site of PAK). It is also possible to measure Rac activity by detecting the activation (autophosphorylation) of PAK, a target molecule of Rac. With respect to lamellipodia structure, it is possible to detect the structure by using an antibody which recognizes a molecule constitutively expressed in actin cytoskeletons or the like.

In order to identify compounds which affect Rac activity through γ-secretase-cleaved intracellular EphA4, each of the steps described above is carried out, and Rac activities in the presence and absence of a candidate compound are compared to thereby evaluate the capacity of the candidate compound. Thus, compounds which change Rac activity through γ-secretase-cleaved intracellular EphA4 are identified. Even a slight change in Rac activity found between the presence and absence of a candidate compound indicates that the Rac activity through γ-secretase-cleaved intracellular EphA4 has been changed by the presence of the candidate compound. This means that a compound which activates Rac through γ-secretase-cleaved intracellular EphA4 or a compound which inhibits Rac through γ-secretase-cleaved intracellular EphA4 has been identified. For example, a compound which increases Rac activity compared with control is evaluated as a Rac activator. On the other hand, a compound which decreases Rac activity compared with control is evaluated as a Rac inhibitor.

The Rac activator may be a compound which inhibits the degradation of γ-secretase-cleaved intracellular EphA4. The Rac inhibitor may be a compound which promotes the degradation of γ-secretase-cleaved intracellular EphA4.

The Rac activator obtainable by the method of the present invention is potentially useful for the treatment of dementia, especially AD.

For those terms used in the fifth embodiment and not particularly explained, the same terms used in the third embodiment described above may be appropriately referred to.

Since it has been already reported that spines are formed upon activation of Rac (Penzes P. et. al., Trends Cell Biol. 2008 September; 18(9):405-13. Epub 2008 Aug. 11), it is easily presumed that intracellular EphA4 processed (cleaved) by γ-secretase induces spine formation after activation of Rac. Therefore, it becomes possible to provide the sixth embodiment described below.

In the sixth embodiment, the method described below is provided. The method of this embodiment is characterized by the use of intracellular EphA4 processed (cleaved) by γ-secretase as in the method of the fifth embodiment. The method of this embodiment may be performed in an appropriate cell system and is capable of evaluating spine formation by incubating Rac expressing cells which have expressed intracellular EphA4 and then measuring the Rac activity in the cells in the presence and absence of a candidate compound.

The screening method of the sixth embodiment comprises the following steps:

(i) culturing Rac expressing cells which have expressed intracellular EphA4 cleaved by γ-secretase;

(ii) measuring Rac activity in the Rac expressing cells cultured in step (i) in the presence and absence of a candidate compound;

(iii) selecting those candidate compounds which affect Rac activity based on the measuring in step (ii); and (iv) identifying the candidate compounds selected in step (iii) as compounds which affect spine formation by γ-secretase-processed EphA4.

In order to identify modulators which affect spine formation through γ-secretase-processed EphA4, the method of the sixth embodiment may be performed in the same manner as in the method of the fifth embodiment except that the candidate compounds selected in step (iv) are not identified as compounds which affect Rac activity mediated by γ-secretase-processed EphA4 but as compounds which affect spine formation by γ-secretase-processed EphA4.

Here, even a slight change found in Rac activity between the presence and absence of a candidate compound indicates that γ-secretase-processed intracellular EphA4 allows spine formation through change in Rac activity with the presence of the candidate compound. This means that a compound which activate the spine formation by γ-secretase-processed intracellular EphA4 or a compound which inhibits the spine formation activity by γ-secretase-processed intracellular EphA4 has been identified. For example, a compound which increases Rac activity compared with control is evaluated as an accelerator for spine formation. On the other hand, a compound which decreases Rac activity compared with control is evaluated as an inhibitor for spine formation.

The accelerator for spine formation obtainable by the method of the present invention is potentially useful for the treatment of dementia, especially AD.

On the other hand, the inhibitor for spine formation obtainable by the method of the present invention is potentially useful for the treatment of diseases accompanied by synaptic hyperplasia (especially, hyperplasia of spine).

For those terms used in the sixth embodiment and not particularly explained, the same terms used in the fifth embodiment described above may be appropriately referred to.

The pharmaceutical composition comprising the compound identified by the method of the present invention, preferably the AD therapeutic of the present invention, may be administered to patients in various forms through an oral or parenteral (e.g., intravenous injection, muscle injection, subcutaneous administration, rectal administration or transdermal administration) route. Therefore, the pharmaceutical composition comprising the compound of the present invention may be formulated into various preparations using a pharmacologically acceptable carrier by a conventional method depending on the administration route, though the pharmaceutical composition may be used alone.

Preferred dosage forms include oral preparations such as tablets, powders, subtle granules, granules, coated tablets, capsules, syrups and troches; and parenteral preparations such as inhalants, suppositories, injections (including drops), ointments, eye drops, ophthalmic ointments, nasal drops, ear drops, cataplasms, and lotions and liposomes.

Examples of carriers used in the formulation include conventionally used fillers, binders, disintegrants, lubricants, coloring agents and flavoring agents, as well as stabilizers, emulsifiers, absorbefacients, surfactants, pH adjusting agents, antiseptics, antioxidants, expanders, wetting agents, surface activators, dispersing agents, buffers, preservatives, dissolution aids and analgesic agents according to necessity. They can be formulated according to a conventional procedure using components commonly used as raw materials for pharmaceutical preparations. Examples of nontoxic these components which may be used in the present invention include animal and vegetable oils such as soybean oil, beef tallow and synthetic glycerides; hydrocarbons such as liquid paraffins, squalane and solid paraffins; ester oils such as octyldodecyl myristate and isopropyl myristate; higher alcohols such as cetostearyl alcohol and behenyl alcohol; silicone resins; silicone oils; surfactants such as polyoxyethylene fatty acid esters, sorbitan fatty acid esters, glycerin fatty acid esters, polyoxyethylene sorbitan fatty acid esters, polyoxyethylene hydrogenated castor oils and polyoxyethylene-polyoxypropylene block copolymers; water-soluble polymers such as hydroxyethyl cellulose, polyacrylic acids, carboxyvinyl polymers, polyethylene glycol, polyvinylpyrrolidone and methylcellulose; lower alcohols such as ethanol and isopropanol; (10) polyhydric alcohols (polyols) such as glycerol, propylene glycol, dipropylene glycol, sorbitol and polyethylene glycol; sugars such as glucose and sucrose; inorganic powders such as silicic anhydride, magnesium aluminium silicate and aluminium silicate; inorganic salts such as sodium chloride and sodium phosphate; and purified water.

The fillers include, for example, lactose, fructose, corn starch, white sugar, glucose, mannitol, sorbitol, crystalline cellulose and silicon dioxide. The binders include, for example, polyvinyl alcohol, polyvinyl ether, methylcellulose, ethylcellulose, gum arabic, gum tragacanth, gelatin, shellac, hydroxypropyl methylcellulose, hydroxypropyl cellulose, polyvinylpyrrolidone, polypropylene glycol-polyoxyethylene block polymers and meglumine. The disintegrants include, for example, starch, agar, gelatin powder, crystalline cellulose, calcium carbonate, sodium hydrogencarbonate, calcium citrate, dextrin, pectin and carboxymethylcellulose calcium. The lubricants include, for example, magnesium stearate, talc, polyethylene glycol, silica and hardened vegetable oils. The coloring agents may be any coloring agents which are approved to be added to pharmaceutical preparations. The flavoring agents include, for example, cocoa powder, menthol, aromatic powder, peppermint oil, camphol (borneol) and cinnamon powder. The above-listed components may be in the form of a salt or solvate thereof.

For example, the oral preparation is produced by mixing the compound of the present invention with a filler, and if necessary, a binder, disintegrant, lubricant, coloring agent, flavoring agent, etc. and formulating the mixture according to conventional procedures into, for example, a powder, subtle granules, granules, tablet, coated tablet or capsules. Resultant tablets and granules can be appropriately coated with, for example, sugar according to necessity. The syrups and injection preparations can be prepared according to conventional procedures by adding a pH adjusting agent, solubilizer, and isotonizing agent, and if necessary, a dissolution aid, stabilizer, etc. The external preparations can be produced according to conventional procedures not specifically limited. Base materials which may be used in the present invention include various raw materials conventionally used in pharmaceutical preparations, quasi drugs and cosmetics. Such raw materials include, for example, animal and vegetable oils, mineral oils, ester oils, waxes, higher alcohols, fatty acids, silicone oils, surfactants, phospholipids, alcohols, polyhydric alcohols, water-soluble polymers, clay minerals and purified water. If necessary, pH adjusting agents, antioxidants, chelating agents, antiseptics and antimolds, coloring agents, flavors, or the like can be added. In addition, components such as blood-flow accelerators, bactericides, anti-inflammatory agents, cell activators, vitamins, amino acids, humectants, keratolytic agents or the like be added according to necessity. The ratio of the active ingredient to carriers may vary from 1 to 90% by weight. When the compounds used in the present invention, the peptides used in the present invention or the polynucleotides used in the present invention are used in the above-described treatment, it is preferable to use those compounds, peptides or polynucleotides purified to 90% or more, preferably 95% or more, more preferably 98% or more, still more preferably 99% or more.

The effective dose of the pharmaceutical composition comprising the compound of the present invention varies depending on the severity of symptom, the age, sex and body weight of the patient, administration mode, type of the salt, difference in sensibility to the drug, specific type of the disease and other factors. Generally, the pharmaceutical composition may be administered to an adult (body weight: 60 kg) in one to several divided doses at a daily dose of about 30 μg to about 10 g, preferably 100 μg to 5 g, and more preferably 100 μg to 100 mg for oral administration, or at a daily dose of about 30 μg to about 1 g, preferably 100 μg to 500 mg, and more preferably 100 μg to 30 mg for injection administration. Considering that efficacy varies depending on the administration route, the required dose is expected to vary widely. For example, it is expected that oral administration requires a higher dose than intravenous injection. When administered to children, the dose may be smaller than the dose for adults. These variations in the dose level can be adjusted by standard empirical optimization procedures which are well understood in the industry.

As the seventh embodiment of the present invention, "intracellular EphA4 cleaved by γ-secretase" (sometimes, simply referred to as "intracellular EphA4") is provided.

As used herein, the term "intracellular EphA4 cleaved by γ-secretase" refers to a polypeptide comprising the EphA4 fragment on the intracellular domain side, said fragment being one of the two fragments produced by processing the EphA4 with the γ-secretase.

The present invention provides the following polypeptide (a) or (b):

(a) a polypeptide consisting of the amino acid sequence as shown in SEQ ID NO: 2n where n represents an integer from 45 to 83;

(b) a polypeptide which has at least 80% or more homology to a polypeptide consisting of the amino acid sequence as shown in SEQ ID NO: 2n where n represents an integer from 45 to 83 and yet has the following activity (c) or (d):

(c) promoting spine formation; or (d) activating Rac.

For example, a polypeptide consisting of the amino acid sequence as shown in SEQ ID NO: 90 may be given (Example 3).

The "intracellular EphA4 cleaved by γ-secretase" includes those polypeptides which are substantially identical with the EphA4 fragment on the intracellular domain side, said fragment being one of the two fragments produced by processing the EphA4 with the γ-secretase. Such substantially identical polypeptides include mutant polypeptides which comprise an amino acid sequence encoding the intracellular EphA4 fragment that may have a deletion, substitution, insertion and/or addition of one or more (preferably one to several) amino acids or that may have a combination of these mutations, and yet are functionally substantially identical with the intracellular EphA4.

The mutant polypeptide described above may be a polypeptide derived from the above-listed animals, a recombinant polypeptide or a synthetic polypeptide, as long as it has an amino acid sequence having preferably 80% or more, more preferably 85% or more, still more preferably 90% or more, still yet more preferably 95% or more, particularly preferably 98% or more, most preferably 99% or more homology with the amino acid sequence of SEQ ID NO: 90 and has substantially the same activity as that of the intracellular EphA4 (e.g., an activity to change postsynapse morphology or function). Alternatively, the mutant polypeptide may be a polypeptide consisting of an amino acid sequence encoded by a polynucleotide which hybridizes to a polynucleotide encoding the amino acid sequence of SEQ ID NO: 90 under stringent conditions.

The identity described above may be values calculated by homology search programs known to those skilled in the art. For example, identity can be calculated by using default parameters in the homology algorithm BLAST (Basic local alignment search tool; http://www.ncbi.nlm.nih.gov/BLAST/) of The National Center for Biotechnology Information (NCBI).

Further, the above-described polypeptide may be a polypeptide consisting of an amino acid sequence encoding a domain within the cytoplasm of the EphA4 fragment on the intracellular domain side generated by the processing of EphA4 by γ-secretase.

For example, the polypeptide may be a polypeptide derived from the above-listed animals, a recombinant polypeptide or a synthetic polypeptide, as long as it has an amino acid sequence having preferably 80% or more, more preferably 85% or more, still more preferably 90% or more, still yet more preferably 95% or more, particularly preferably 98% or more, most preferably 99% or more homology with the amino acid sequence of SEQ ID NO: 92 and has substantially the same activity as that of the intracellular EphA4 (e.g., an activity to change postsynapse morphology or function). Alternatively, the polypeptide may be a polypeptide consisting of an amino acid sequence encoded by a polynucleotide which hybridizes to a polynucleotide encoding the amino acid sequence of SEQ ID NO: 92 under stringent conditions.

The above-described intracellular EphA4 may take any of the following forms: a fusion polypeptide fused to other polypeptide, a tagged or labeled polypeptide or a polypeptide otherwise modified. These polypeptides may be obtained by recombinant DNA techniques, site-directed mutagenesis, treatment with mutagenic agents (such as hydroxylamine), or automated peptide synthesis.

Preferred embodiments of the intracellular EphA4 cleaved by γ-secretase of the present invention are as shown in Table 3 below. Preferable examples are rat intracellular EphA4 polypeptide, more specifically, polypeptides comprising the amino acid sequence as shown in SEQ ID NO: 90 or 92. Further, a preferred embodiment of the intracellular EphA4 of the present invention is an HA-tagged rat intracellular EphA4. For example, a rat EphA4 polypeptide with an HA tag added at its N-terminus (SEQ ID NO: 94) may be given Example 4). It is for granted that polypeptides comprising the whole or a part of an intracellular EphA4 amino acid sequence derived from an animal other than rat may also be used in the same manner as rat intracellular EphA4 polypeptides. For example, the SEQ ID NOS listed in Table 3, more specifically, amino acid sequences selected from SEQ ID NOS: 96, 98, 100, 102, 104, 106, 108, 110, 112, 114, 142, 144, 146, 148, 150, 152, 154, 156, 158, 160, 162, 164, 166, 116, 118, 120, 122, 124, 126, 128, 130, 132, 134, 136, 138 and 140, and SEQ ID NO: 146 (HA tag added) may be used. Preferably, the whole or a part of human intracellular EphA4 amino acid sequence is used.

| | (Intracellular Fragment) | | |
|---|---|---|---|
| Source or Type | Accession No. | Nucleotide Sequence | Amino Acid Sequence |
| Rat (Rattus norvegicus) | XM_244186.3 (actually measured) | SEQ ID NO: 89 | SEQ ID NO: 90 |
| | XM_244186.3 (EICD) | SEQ ID NO: 91 | SEQ ID NO: 92 |
| Rat EphA4-HA | XM_244186.3 | SEQ ID NO: 93 | SEQ ID NO: 94 |
| Human (Homo sapiens) | NM_004438 | SEQ ID NO: 95 | SEQ ID NO: 96 |
| | BC026327 | SEQ ID NO: 97 | SEQ ID NO: 98 |
| | NP_004429.1 | SEQ ID NO: 145 | SEQ ID NO: 146 |
| | BAG35298.1 | SEQ ID NO: 147 | SEQ ID NO: 148 |

-continued (Intracellular Fragment)

| Source or Type | Accession No. | Nucleotide Sequence | Amino Acid Sequence |
|---|---|---|---|
| Human EphA4-HA | NM_004438 | SEQ ID NO: 99 | SEQ ID NO: 100 |
| Mouse | NM_007936 | SEQ ID NO: 101 | SEQ ID NO: 102 |
| (*Mus musculus*) | BC052164 | SEQ ID NO: 103 | SEQ ID NO: 104 |
| | X65138 | SEQ ID NO: 105 | SEQ ID NO: 106 |
| | BC004782 | SEQ ID NO: 107 | SEQ ID NO: 108 |
| | AAH04782.1 | SEQ ID NO: 141 | SEQ ID NO: 142 |
| | NP_031962.2 | SEQ ID NO: 143 | SEQ ID NO: 144 |
| Gray short-tailed opossum (*Monodelphis domestica*) | XM_001365826 | SEQ ID NO: 109 | SEQ ID NO: 110 |
| Dog | XM_536084.2 | SEQ ID NO: 111 | SEQ ID NO: 112 |
| (*Canis lupus familiaris*) | XM_536084.2 | SEQ ID NO: 155 | SEQ ID NO: 156 |
| Chimpanzee | XM_001164636 | SEQ ID NO: 113 | SEQ ID NO: 114 |
| (*Pan troglodytes*) | XM_001164828 | SEQ ID NO: 115 | SEQ ID NO: 116 |
| | XM_526042.2 | SEQ ID NO: 117 | SEQ ID NO: 118 |
| | XM_526042.2 | SEQ ID NO: 153 | SEQ ID NO: 154 |
| | XM_001164899 | SEQ ID NO: 119 | SEQ ID NO: 120 |
| Rheus monkey | XM_001106493 | SEQ ID NO: 121 | SEQ ID NO: 122 |
| (*Macaca mulatta*) | XM_001106620 | SEQ ID NO: 123 | SEQ ID NO: 124 |
| | XM_001106561 | SEQ ID NO: 125 | SEQ ID NO: 126 |
| | XM_001106876.1 | SEQ ID NO: 127 | SEQ ID NO: 128 |
| | XM_001106876.1 | SEQ ID NO: 151 | SEQ ID NO: 152 |
| | XP_001106430.1 | SEQ ID NO: 149 | SEQ ID NO: 150 |
| Chicken | NM_204781 | SEQ ID NO: 129 | SEQ ID NO: 130 |
| (*Gallus gallus*) | CAA79509.1 | SEQ ID NO: 159 | SEQ ID NO: 160 |
| African clawed frog | NM_001085992 | SEQ ID NO: 131 | SEQ ID NO: 132 |
| (*Xenopus laevis*) | L26099 | SEQ ID NO: 133 | SEQ ID NO: 134 |
| | NM_001096714 | SEQ ID NO: 135 | SEQ ID NO: 136 |
| | NP_001079461.1 | SEQ ID NO: 165 | SEQ ID NO: 166 |
| Zebra fish | NM_001005919 | SEQ ID NO: 137 | SEQ ID NO: 138 |
| (*Danio rerio*) | XM_001342436 | SEQ ID NO: 139 | SEQ ID NO: 140 |
| Horse (*Equus caballus*) | XP_001494588.1 | SEQ ID NO: 157 | SEQ ID NO: 158 |
| Pig (*Sus scrofa*) | NP_001128439.1 | SEQ ID NO: 161 | SEQ ID NO: 162 |
| Platypus (*Ornithorhynchus anatinus*) | XP_001506050.1 | SEQ ID NO: 163 | SEQ ID NO: 164 |

Further, the present invention provides polynucleotides comprising nucleotide sequences encoding the above-described intracellular EphA4 cleaved by γ-secretase. Preferred embodiments of nucleotide sequences encoding the intracellular EphA4 of the present invention are as shown in Table 3 above. One example of such a polynucleotide encoding the intracellular EphA4 is a polynucleotide encoding rat intracellular EphA4, e.g. the polynucleotide as shown in SEQ ID NO: 89. Other examples of preferred embodiments of polynucleotides encoding the intracellular EphA4 of the present invention include the polynucleotide as shown in SEQ ID NO: 89 or 91. A polynucleotide encoding an HA tag-added rat intracellular EphA4 is also preferable. One example of such a polynucleotide is a polynucleotide (SEQ ID NO: 93) encoding a rat intracellular EphA4 polypeptide in which an HA tag has been added at its N-terminus (Example 4). It is for granted that the whole or a part of a nucleotide sequence encoding intracellular EphA4 derived from an animal other than rat may also be used in the same manner as rat intracellular EphA4 polynucleotides. For example, nucleotide sequences selected from SEQ ID NOS: 95, 97, 99, 101, 103, 105, 107, 109, 111, 113, 141, 143, 145, 147, 149, 151, 153, 155, 157, 159, 161, 163, 165, 115, 117, 119, 121, 123, 125, 127, 129, 131, 133, 135, 137 and 139, and SEQ ID NO: 145 (HA tag added) may be used. Preferably, the whole or a part of a nucleotide sequence encoding human intracellular EphA4 is used.

A still more preferred embodiment of the intracellular EphA4 of the present invention is an intracellular EphA4 which rises (activates) Rac-mediated signaling pathways. The term "Rac" used herein refers to GTPases (Rac1, Rac2 and Rac3) which constitute a family belonging to small GTP-binding proteins in the Ras super family. Especially preferably, "Rac" refers to Rac1.

The expression "intracellular EphA4 having a Rac activity" used herein means a polypeptide which activates Rac-mediated signaling pathways or a polypeptide which accelerates spine formation (hereinafter, sometimes referred to as "polypeptide having a Rac activity"), wherein both polypeptides are included in the above-described "intracellular EphA4". The intracellular EphA4 having a Rac activity is a polypeptide wherein at least the sequences of (a) autophosphorylation site and (b) ATP-binding site are conserved compared to the sequence of the above-described "intracellular EphA4" (Example 6).

In a preferred embodiment of the present invention, the intracellular EphA4 having a Rac activity is rat intracellular EphA4 having a Rac activity.

Examples of the intracellular EphA4 having a Rac activity include those polypeptides having preferably 80% or more, more preferably 85% or more, still more preferably 90% or more, still more preferably 95% or more, particularly preferably 98% or more, and most preferably 99% or more homology to a polypeptide consisting of a partial sequence of a polypeptide having the amino acid sequence as shown in SEQ ID NO: 2, the N-terminus of the partial sequence starting between positions 564 and 621, preferably between 564 and 587, of SEQ ID NO: 2. More preferably, the above-described polypeptide has the following activity (a) or (b):
(a) promoting spine formation; or
(b) activating Rac.

Alternatively, the intracellular EphA4 having a Rac activity may be a polypeptide consisting of a partial sequence of the amino acid sequence as shown in SEQ ID NO: 2, wherein the polypeptide has the following amino acid sequence (a) or (b) and yet has the following activity (c) or (d):
(a) an amino acid sequence having at least 95% or more homology to a partial amino acid sequence of SEQ ID NO: 2 whose N-terminus starts between positions 564 and 621, preferably between positions 564 and 587, of SEQ ID NO: 2; or
(b) an amino acid sequence encoded by a polynucleotide which hybridizes to the complementary strand of a polynucleotide encoding a partial amino acid sequence of SEQ ID NO: 2 whose N-terminus starts between positions 564 and 621, preferably between positions 564 and 587, of SEQ ID NO: 2 under stringent conditions;
(c) promoting spine formation; or
(d) activating Rac.

In the above-described partial sequence, it is preferred that the C-terminal sequence thereof coincides with the C-terminal sequence of the amino acid sequence as shown in SEQ ID NO: 2.

A still preferred embodiment of the intracellular EphA4 having a Rac activity is a polypeptide having the amino acid sequence as shown in SEQ ID NO: 90, 92 or 196.

When the above-described conditions are satisfied, the intracellular EphA4 having a Rac activity may be a polypeptide derived from an animal other than those listed above, a recombinant polypeptide, or a synthetic polypeptide. Stringent conditions are the same as described above.

The intracellular EphA4 having a Rac activity may any of the following forms: a fusion polypeptide fuse to other polypeptide (such as labeled (e.g. tagged) polypeptide), or a polypeptide otherwise modified.

Further, a preferred embodiment of the intracellular EphA4 of the present invention is an HA tag-added rat intracellular EphA4 polypeptide. Examples of such a polypeptide include those polypeptides in which an HA tag has been added at the N-terminus of rat intracellular EphA4 having a Rac activity (SEQ ID NOS: 198, 94 and 168) (Examples 6 to 8).

It is for granted that the whole of a part of intracellular EphA4 sequences having a Rac activity derived from animals other than rat may also be used in the same manner as rat intracellular EphA4 having a Rac activity. Hereinbelow, intracellular EphA4 polypeptides having a Rac activity derived from animals other than rat will be illustrated.

For example, in the case of mouse (AAH04782.1), intracellular EphA4 having a Rac activity is a polypeptide having preferably 80% or more, more preferably 85% or more, still more preferably 90% or more, still more preferably 95% or more, particularly preferably 98% or more, and most preferably 99% or more homology to a polypeptide consisting of a partial sequence of a polypeptide having the amino acid sequence as shown in SEQ ID NO: 176, the N-terminus of the partial sequence starting between positions 505 and 562, preferably between 505 and 527, of SEQ ID NO: 176. More preferably, the above-described polypeptide has the following activity (a) or (b):
(a) promoting spine formation; or
(b) activating Rac.

Alternatively, the intracellular EphA4 having a Rac activity may be a polypeptide consisting of a partial sequence of the amino acid sequence as shown in SEQ ID NO: 176, wherein the polypeptide has the following amino acid sequence (a) or (b) and yet has the following activity (c) or (d):
(a) an amino acid sequence having at least 95% or more homology to a partial amino acid sequence of SEQ ID NO: 176 whose N-terminus starts between positions 505 and 562, preferably between positions 505 and 527, of SEQ ID NO: 176; or
(b) an amino acid sequence encoded by a polynucleotide which hybridizes to the complementary strand of a polynucleotide encoding a partial amino acid sequence of SEQ ID NO: 176 whose N-terminus starts between positions 505 and 562, preferably between positions 505 and 527, of SEQ ID NO: 176 under stringent conditions;
(c) promoting spine formation; or
(d) activating Rac.

In the case of mouse (NP_031962.2), intracellular EphA4 having a Rac activity is a polypeptide having preferably 80% or more, more preferably 85% or more, still more preferably 90% or more, still more preferably 95% or more, particularly preferably 98% or more, and most preferably 99% or more homology to a polypeptide consisting of a partial sequence of a polypeptide having the amino acid sequence as shown in SEQ ID NO: 178, the N-terminus of the partial sequence starting between positions 564 and 621, preferably between 564 and 586, of SEQ ID NO: 178. More preferably, the above-described polypeptide has the following activity (a) or (b):
(a) promoting spine formation; or
(b) activating Rac.

Alternatively, the intracellular EphA4 having a Rac activity may be a polypeptide consisting of a partial sequence of the amino acid sequence as shown in SEQ ID NO: 178, wherein the polypeptide has the following amino acid sequence (a) or (b) and yet has the following activity (c) or (d):
(a) an amino acid sequence having at least 95% or more homology to a partial amino acid sequence of SEQ ID NO: 178 whose N-terminus starts between positions 564 and 621, preferably between positions 564 and 586, of SEQ ID NO: 178; or
(b) an amino acid sequence encoded by a polynucleotide which hybridizes to the complementary strand of a polynucleotide encoding a partial amino acid sequence of SEQ ID NO: 178 whose N-terminus starts between positions 564 and 621, preferably between positions 564 and 586, of SEQ ID NO: 178 under stringent conditions;
(c) promoting spine formation; or
(d) activating Rac.

In the case of human (NP_004429.1), intracellular EphA4 having a Rac activity is a polypeptide having preferably 80% or more, more preferably 85% or more, still more preferably 90% or more, still more preferably 95% or more, particularly preferably 98% or more, and most preferably 99% or more homology to a polypeptide consisting of a partial sequence of a polypeptide having the amino acid sequence as shown in SEQ ID NO: 180, the N-terminus of the partial sequence starting between positions 564 and 621, preferably between 564 and 586, of SEQ ID NO: 180. More preferably, the above-described polypeptide has the following activity (a) or (b):
(a) promoting spine formation; or
(b) activating Rac.

Alternatively, the intracellular EphA4 having a Rac activity may be a polypeptide consisting of a partial sequence of the amino acid sequence as shown in SEQ ID NO: 180, wherein the polypeptide has the following amino acid sequence (a) or (b) and yet has the following activity (c) or (d):

(a) an amino acid sequence having at least 95% or more homology to a partial amino acid sequence of SEQ ID NO: 180 whose N-terminus starts between positions 564 and 621, preferably between positions 564 and 586, of SEQ ID NO: 180; or (b) an amino acid sequence encoded by a polynucleotide which hybridizes to the complementary strand of a polynucleotide encoding a partial amino acid sequence of SEQ ID NO: 180 whose N-terminus starts between positions 564 and 621, preferably between positions 564 and 586, of SEQ ID NO: 180 under stringent conditions;

(c) promoting spine formation; or (d) activating Rac.

In the case of human (BAG35298.1), intracellular EphA4 having a Rac activity is a polypeptide having preferably 80% or more, more preferably 85% or more, still more preferably 90% or more, still more preferably 95% or more, particularly preferably 98% or more, and most preferably 99% or more homology to a polypeptide consisting of a partial sequence of a polypeptide having the amino acid sequence as shown in SEQ ID NO: 182, the N-terminus of the partial sequence starting between positions 564 and 621, preferably between 564 and 586, of SEQ ID NO: 182. More preferably, the above-described polypeptide has the following activity (a) or (b):

(a) promoting spine formation; or (b) activating Rac.

Alternatively, the intracellular EphA4 having a Rac activity may be a polypeptide consisting of a partial sequence of the amino acid sequence as shown in SEQ ID NO: 182, wherein the polypeptide has the following amino acid sequence (a) or (b) and yet has the following activity (c) or (d):

(a) an amino acid sequence having at least 95% or more homology to a partial amino acid sequence of SEQ ID NO: 182 whose N-terminus starts between positions 564 and 621, preferably between positions 564 and 586, of SEQ ID NO: 182; or (b) an amino acid sequence encoded by a polynucleotide which hybridizes to the complementary strand of a polynucleotide encoding a partial amino acid sequence of SEQ ID NO: 182 whose N-terminus starts between positions 564 and 621, preferably between positions 564 and 586, of SEQ ID NO: 182 under stringent conditions;

(c) promoting spine formation; or (d) activating Rac.

In the case of rheus monkey (XP_001106430.1), intracellular EphA4 having a Rac activity is a polypeptide having preferably 80% or more, more preferably 85% or more, still more preferably 90% or more, still more preferably 95% or more, particularly preferably 98% or more, and most preferably 99% or more homology to a polypeptide consisting of a partial sequence of a polypeptide having the amino acid sequence as shown in SEQ ID NO: 184, the N-terminus of the partial sequence starting between positions 505 and 562, preferably between 505 and 527, of SEQ ID NO: 184. More preferably, the above-described polypeptide has the following activity (a) or (b):

(a) promoting spine formation; or (b) activating Rac.

Alternatively, the intracellular EphA4 having a Rac activity may be a polypeptide consisting of a partial sequence of the amino acid sequence as shown in SEQ ID NO: 184, wherein the polypeptide has the following amino acid sequence (a) or (b) and yet has the following activity (c) or (d):

(a) an amino acid sequence having at least 95% or more homology to a partial amino acid sequence of SEQ ID NO: 184 whose N-terminus starts between positions 505 and 562, preferably between positions 505 and 527, of SEQ ID NO: 184; or (b) an amino acid sequence encoded by a polynucleotide which hybridizes to the complementary strand of a polynucleotide encoding a partial amino acid sequence of SEQ ID NO: 184 whose N-terminus starts between positions 505 and 562, preferably between positions 505 and 527, of SEQ ID NO: 184 under stringent conditions;

(c) promoting spine formation; or (d) activating Rac.

In the case of rheus monkey (XP_001106876.1), intracellular EphA4 having a Rac activity is a polypeptide having preferably 80% or more, more preferably 85% or more, still more preferably 90% or more, still more preferably 95% or more, particularly preferably 98% or more, and most preferably 99% or more homology to a polypeptide consisting of a partial sequence of a polypeptide having the amino acid sequence as shown in SEQ ID NO: 42, the N-terminus of the partial sequence starting between positions 564 and 627, preferably between 564 and 586, of SEQ ID NO: 42. More preferably, the above-described polypeptide has the following activity (a) or (b):

(a) promoting spine formation; or (b) activating Rac.

Alternatively, the intracellular EphA4 having a Rac activity may be a polypeptide consisting of a partial sequence of the amino acid sequence as shown in SEQ ID NO: 42, wherein the polypeptide has the following amino acid sequence (a) or (b) and yet has the following activity (c) or (d):

(a) an amino acid sequence having at least 95% or more homology to a partial amino acid sequence of SEQ ID NO: 42 whose N-terminus starts between positions 564 and 627, preferably between positions 564 and 586, of SEQ ID NO: 42; or (b) an amino acid sequence encoded by a polynucleotide which hybridizes to the complementary strand of a polynucleotide encoding a partial amino acid sequence of SEQ ID NO: 42 whose N-terminus starts between positions 564 and 627, preferably between positions 564 and 586, of SEQ ID NO: 42 under stringent conditions;

(c) promoting spine formation; or (d) activating Rac.

In the case of chimpanzee (XP_526042.2), intracellular EphA4 having a Rac activity is a polypeptide having preferably 80% or more, more preferably 85% or more, still more preferably 90% or more, still more preferably 95% or more, particularly preferably 98% or more, and most preferably 99% or more homology to a polypeptide consisting of a partial sequence of a polypeptide having the amino acid sequence as shown in SEQ ID NO: 28, the N-terminus of the partial sequence starting between positions 505 and 562, preferably between 505 and 527, of SEQ ID NO: 28. More preferably, the above-described polypeptide has the following activity (a) or (b):

(a) promoting spine formation; or (b) activating Rac.

Alternatively, the intracellular EphA4 having a Rac activity may be a polypeptide consisting of a partial sequence of the amino acid sequence as shown in SEQ ID NO: 28, wherein the polypeptide has the following amino acid sequence (a) or (b) and yet has the following activity (c) or (d):

(a) an amino acid sequence having at least 95% or more homology to a partial amino acid sequence of SEQ ID NO: 28 whose N-terminus starts between positions 505 and 562, preferably between positions 505 and 527, of SEQ ID NO: 28; or (b) an amino acid sequence encoded by a polynucleotide which hybridizes to the complementary strand of a polynucleotide encoding a partial amino acid sequence of SEQ ID NO: 28 whose N-terminus starts between positions 505 and 562, preferably between positions 505 and 527, of SEQ ID NO: 28 under stringent conditions;

(c) promoting spine formation; or (d) activating Rac.

In the case of dog (XP_536084.2), intracellular EphA4 having a Rac activity is a polypeptide having preferably 80% or more, more preferably 85% or more, still more preferably 90% or more, still more preferably 95% or more, particularly preferably 98% or more, and most preferably 99% or more homology to a polypeptide consisting of a partial sequence of a polypeptide having the amino acid sequence as shown in SEQ ID NO: 22, the N-terminus of the partial sequence starting between positions 605 and 662, preferably between 605 and 627, of SEQ ID NO: 22. More preferably, the above-described polypeptide has the following activity (a) or (b):

(a) promoting spine formation; or (b) activating Rac.

Alternatively, the intracellular EphA4 having a Rac activity may be a polypeptide consisting of a partial sequence of the amino acid sequence as shown in SEQ ID NO: 22, wherein the polypeptide has the following amino acid sequence (a) or (b) and yet has the following activity (c) or (d):

(a) an amino acid sequence having at least 95% or more homology to a partial amino acid sequence of SEQ ID NO: 22 whose N-terminus starts between positions 605 and 662, preferably between positions 605 and 627, of SEQ ID NO: 22; or (b) an amino acid sequence encoded by a polynucleotide which hybridizes to the complementary strand of a polynucleotide encoding a partial amino acid sequence of SEQ ID NO: 22 whose N-terminus starts between positions 605 and 662, preferably between positions 605 and 627, of SEQ ID NO: 22 under stringent conditions;

(c) promoting spine formation; or (d) activating Rac.

In the case of horse (XP_001494588.1), intracellular EphA4 having a Rac activity is a polypeptide having preferably 80% or more, more preferably 85% or more, still more preferably 90% or more, still more preferably 95% or more, particularly preferably 98% or more, and most preferably 99% or more homology to a polypeptide consisting of a partial sequence of a polypeptide having the amino acid sequence as shown in SEQ ID NO: 186, the N-terminus of the partial sequence starting between positions 564 and 621, preferably between 564 and 586, of SEQ ID NO: 186. More preferably, the above-described polypeptide has the following activity (a) or (b):

(a) promoting spine formation; or (b) activating Rac.

Alternatively, the intracellular EphA4 having a Rac activity may be a polypeptide consisting of a partial sequence of the amino acid sequence as shown in SEQ ID NO: 186, wherein the polypeptide has the following amino acid sequence (a) or (b) and yet has the following activity (c) or (d):

(a) an amino acid sequence having at least 95% or more homology to a partial amino acid sequence of SEQ ID NO: 186 whose N-terminus starts between positions 564 and 621, preferably between positions 564 and 586, of SEQ ID NO: 186; or (b) an amino acid sequence encoded by a polynucleotide which hybridizes to the complementary strand of a polynucleotide encoding a partial amino acid sequence of SEQ ID NO: 186 whose N-terminus starts between positions 564 and 621, preferably between positions 564 and 586, of SEQ ID NO: 186 under stringent conditions;

(c) promoting spine formation; or (d) activating Rac.

In the case of chicken (CAA79509.1), intracellular EphA4 having a Rac activity is a polypeptide having preferably 80% or more, more preferably 85% or more, still more preferably 90% or more, still more preferably 95% or more, particularly preferably 98% or more, and most preferably 99% or more homology to a polypeptide consisting of a partial sequence of a polypeptide having the amino acid sequence as shown in SEQ ID NO: 188, the N-terminus of the partial sequence starting between positions 427 and 484, preferably between 427 and 449, of SEQ ID NO: 188. More preferably, the above-described polypeptide has the following activity (a) or (b):

(a) promoting spine formation; or (b) activating Rac.

Alternatively, the intracellular EphA4 having a Rac activity may be a polypeptide consisting of a partial sequence of the amino acid sequence as shown in SEQ ID NO: 188, wherein the polypeptide has the following amino acid sequence (a) or (b) and yet has the following activity (c) or (d):

(a) an amino acid sequence having at least 95% or more homology to a partial amino acid sequence of SEQ ID NO: 188 whose N-terminus starts between positions 427 and 484, preferably between positions 427 and 449, of SEQ ID NO: 188; or (b) an amino acid sequence encoded by a polynucleotide which hybridizes to the complementary strand of a polynucleotide encoding a partial amino acid sequence of SEQ ID NO: 188 whose N-terminus starts between positions 427 and 484, preferably between positions 427 and 449 of SEQ ID NO: 188 under stringent conditions;

(c) promoting spine formation; or (d) activating Rac.

In the case of pig (NP_001128439.1), intracellular EphA4 having a Rac activity is a polypeptide having preferably 80% or more, more preferably 85% or more, still more preferably 90% or more, still more preferably 95% or more, particularly preferably 98% or more, and most preferably 99% or more homology to a polypeptide consisting of a partial sequence of a polypeptide having the amino acid sequence as shown in SEQ ID NO: 190, the N-terminus of the partial sequence starting between positions 564 and 621, preferably between 564 and 586, of SEQ ID NO: 190. More preferably, the above-described polypeptide has the following activity (a) or (b):

(a) promoting spine formation; or (b) activating Rac.

Alternatively, the intracellular EphA4 having a Rac activity may be a polypeptide consisting of a partial sequence of the amino acid sequence as shown in SEQ ID NO: 190, wherein the polypeptide has the following amino acid sequence (a) or (b) and yet has the following activity (c) or (d):

(a) an amino acid sequence having at least 95% or more homology to a partial amino acid sequence of SEQ ID NO: 190 whose N-terminus starts between positions 564 and 621, preferably between positions 564 and 586, of SEQ ID NO: 190; or (b) an amino acid sequence encoded by a polynucleotide which hybridizes to the complementary strand of a polynucleotide encoding a partial amino acid sequence of SEQ ID NO: 190 whose N-terminus starts between positions 564 and 621, preferably between positions 564 and 586, of SEQ ID NO: 190 under stringent conditions;

(c) promoting spine formation; or (d) activating Rac.

In the case of platypus (XP_001506050.1), intracellular EphA4 having a Rac activity is a polypeptide having preferably 80% or more, more preferably 85% or more, still more preferably 90% or more, still more preferably 95% or more, particularly preferably 98% or more, and most preferably 99% or more homology to a polypeptide consisting of a partial sequence of a polypeptide having the amino acid sequence as shown in SEQ ID NO: 192, the N-terminus of the partial sequence starting between positions 564 and 621, preferably between 564 and 586, of SEQ ID NO: 192. More preferably, the above-described polypeptide has the following activity (a) or (b):

(a) promoting spine formation; or (b) activating Rac.

Alternatively, the intracellular EphA4 having a Rac activity may be a polypeptide consisting of a partial sequence of the amino acid sequence as shown in SEQ ID NO: 192, wherein the polypeptide has the following amino acid sequence (a) or (b) and yet has the following activity (c) or (d):

(a) an amino acid sequence having at least 95% or more homology to a partial amino acid sequence of SEQ ID NO: 192 whose N-terminus starts between positions 564 and 621, preferably between positions 564 and 586, of SEQ ID NO: 192; or (b) an amino acid sequence encoded by a polynucleotide which hybridizes to the complementary strand of a polynucleotide encoding a partial amino acid sequence of SEQ ID NO: 192 whose N-terminus starts between positions 564 and 621, preferably between positions 564 and 586, of SEQ ID NO: 192 under stringent conditions;

(c) promoting spine formation; or (d) activating Rac.

In the case of frog (NP_001079461.1), intracellular EphA4 having a Rac activity is a polypeptide having preferably 80% or more, more preferably 85% or more, still more preferably 90% or more, still more preferably 95% or more, particularly preferably 98% or more, and most preferably 99% or more homology to a polypeptide consisting of a partial sequence of a polypeptide having the amino acid sequence as shown in SEQ ID NO: 194, the N-terminus of the partial sequence starting between positions 563 and 619, preferably between 563 and 585, of SEQ ID NO: 194. More preferably, the above-described polypeptide has the following activity (a) or (b):

(a) promoting spine formation; or (b) activating Rac.

Alternatively, the intracellular EphA4 having a Rac activity may be a polypeptide consisting of a partial sequence of the amino acid sequence as shown in SEQ ID NO: 194, wherein the polypeptide has the following amino acid sequence (a) or (b) and yet has the following activity (c) or (d):

(a) an amino acid sequence having at least 95% or more homology to a partial amino acid sequence of SEQ ID NO: 194 whose N-terminus starts between positions 563 and 619, preferably between positions 563 and 585, of SEQ ID NO: 194; or (b) an amino acid sequence encoded by a polynucleotide which hybridizes to the complementary strand of a polynucleotide encoding a partial amino acid sequence of SEQ ID NO: 194 whose N-terminus starts between positions 563 and 619, preferably between positions 563 and 585, of SEQ ID NO: 194 under stringent conditions;

(c) promoting spine formation; or (d) activating Rac.

The illustrations described above were obtained by determining through calculation those sequences which have 95% or more homology to the sequence of the intracellular side fragment of γ-secretase-cleaved rat EphA4 (XM_244186.3).

A still more preferred embodiment is the whole of a part of the sequence of human intracellular EphA4 having a Rac activity.

Further, the present invention provides polynucleotides comprising a nucleotide sequence encoding intracellular EphA4 having Rac activity. In the present invention, the following polynucleotide (a), (b) or (c) is provided.

(a) A polynucleotide encoding the amino acid sequence as shown in SEQ ID NO: 2n where n represents an integer from 45 to 83;

(b) A polynucleotide consisting of the nucleotide sequence as shown in SEQ ID NO: 2n−1 where n represents an integer from 45 to 83;

(c) A polynucleotide which hybridizes to the complementary strand of the polynucleotide (a) or (b) under stringent conditions and yet encodes a polypeptide having the following activity (d) or (e):

(d) promoting spine formation; or (e) activating Rac.

One example of such a nucleotide sequence encoding intracellular EphA4 having a Rac activity is a polynucleotide encoding rat intracellular EphA4 having a Rac activity.

For example, the following polynucleotide may be given:

A polynucleotide which consists of a partial sequence of a polynucleotide encoding the amino acid sequence as shown in SEQ ID NO: 2, and encodes a polypeptide consisting of a partial sequence of the amino acid sequence as shown in SEQ ID NO: 2 whose N-terminus starts between positions 564 and 621, preferably 564 and 587, of SEQ ID NO: 2. More preferably, the polynucleotide encodes the amino acid sequence of a polypeptide having the following activity (a) or (b):

(a) promoting spine formation; or (b) activating Rac.

Alternatively, the following polynucleotide may be given:

A polynucleotide consisting of a partial sequence of a polynucleotide encoding the amino acid sequence as shown in SEQ ID NO: 2, wherein the former polynucleotide has the following nucleotide sequence (a) or (b) and yet encodes the amino acid sequence of a polypeptide having the following activity (c) or (d):

(a) a nucleotide sequence having at least 95% or more homology to a nucleotide sequence encoding a polypeptide consisting of a partial amino acid sequence of SEQ ID NO: 2 whose N-terminus starts between positions 564 and 621, preferably 564 and 587, of SEQ ID NO:2; or (b) a nucleotide sequence which hybridizes to the complementary strand of a nucleotide sequence encoding a polypeptide consisting of a partial amino acid sequence of SEQ ID NO: 2 whose N-terminus starts between positions 564 and 621, preferably 564 and 587, of SEQ ID NO: 2 under stringent conditions;

(c) promoting spine formation; or (b) activating Rac.

More preferably, a polynucleotide is given which is encoded by the nucleotide sequence as shown in SEQ ID NO: 89, 91 or 195.

Further, another preferred embodiment of the polynucleotide encoding intracellular EphA4 having a Rac activity of the present invention is a polynucleotide encoding an HA-tagged rat intracellular EphA4 polypeptide having a Rac activity. Specific examples include the polynucleotides of SEQ ID NOS: 93, 167 and 197 which encode polypeptides wherein an HA tag has been added at the N-terminus of rat intracellular EphA4 having a Rac activity (Examples 6 to 8).

It is for granted that those polynucleotides encoded by nucleotide sequences corresponding to the whole of a part of intracellular EphA4 having a Rac activity derived from animals other than rat (e.g., the above-illustrated amino acid sequences of intracellular EphA4 having Rac activity derived from animals other than rat) may also be used in the same manner as polynucleotides encoding rat intracellular EphA4 having a Rac activity.

A still more preferred embodiment of the polynucleotide is a polynucleotide corresponding to the whole or a part of human intracellular EphA4 sequence having a Rac activity.

The intracellular EphA4 cleaved by the γ-secretase of the present invention may be determined by the method described below.

Briefly, EphA4 cleavage reaction by γ-secretase was performed. From the reaction products, affinity-purified tagged EphA4 protein fragments were obtained using an antibody specific to a tag at the C-terminus of EphA4. The resultant protein fragments were separated by SDS-PAGE, and gel sections containing the fragments were cut out. The gel sections were subjected to digestion with protease. The resultant peptide sections were subjected to LC-MS/MS analysis to thereby find peptides containing a cleavage site. By analysis of tandem MS spectra, the amino acid sequence of the site of EphA4 at which EphA4 was cleaved by γ-secretase has been determined for the first time.

Although the present inventors attempted to determine the sequence of γ-secretase cleaved EphA4 intracellular fragment based on homology in various membrane proteins using databases concerning known protein families and domains as well as transmembrane domain analysis software, it was impossible to specify the sequence because a plurality of cleavage sites were assumed.

As the eighth embodiment, the present invention provides "antibodies to the intracellular EphA4 cleaved by γ-secretase (hereinafter, sometimes abbreviated to "antibodies to the protein of the invention").

The antibodies to the intracellular EphA4 may be either polyclonal antibodies or monoclonal antibodies, as long as they are capable of recognizing a polypeptide corresponding to the whole or a part of the intracellular EphA4 sequence. An especially preferred embodiment of such antibodies is an antibody which specifically recognizes a polypeptide corresponding to the whole or a part of the intracellular EphA4 sequence.

The "antibody which specifically recognizes a polypeptide corresponding to the whole or a part of the intracellular EphA4 sequence" includes an antibody that does not recognize EphA4 polypeptides unprocessed by γ-secretase (e.g., full-length EphA4 polypeptide) but recognizes a polypeptide corresponding to the whole or a part of the intracellular EphA4 sequence; and an antibody that recognizes a polypeptide corresponding to the whole or a part of the intracellular EphA4 sequence and yet has a binding affinity 10 to 50 times, preferably 20 to 50 times, greater than that of antibodies which recognize full-length EphA4 polypeptide.

Antibodies to intracellular EphA4 may be prepared according to known methods for preparing antibodies or antisera using intracellular EphA4 as antigen.

[Preparation of Monoclonal Antibody]

(a) Preparation of Monoclonal Antibody-Producing Cells

The protein of the present invention is administered to warm-blooded animals either solely or together with carriers or diluents to the site where the production of antibody is possible by the administration. In order to potentiate the antibody productivity upon the administration, complete Freund's adjuvants or incomplete Freund's adjuvants may be administered. The administration is usually carried out once every two to six weeks and two to ten times in total. Examples of the applicable warm-blooded animals are monkey, rabbit, dog, guinea pig, mouse, rat, sheep, goat and chicken, with the use of mouse and rat being preferred.

In the preparation of monoclonal antibody-producing cells, a warm-blooded animal, e.g., mouse, immunized with an antigen wherein the antibody titer was noted is selected, then spleen or lymph node is collected after two to five days from the final immunization and antibody-producing cells contained therein are fused with myeloma cells from an animal of the same species or different species to give monoclonal antibody-producing hybridomas. Measurement of the antibody titer in antisera may be carried out, for example, by reacting a labeled protein, which will be described later, with the antiserum followed by assaying the binding activity of the labeling agent bound to the antibody. The fusion may be carried out, for example, by the known method by Koehler and Milstein [Nature, 256, 495 (1975)]. Examples of the fusion accelerator are polyethylene glycol (PEG), Sendai virus, etc., of which PEG is preferably employed.

Examples of the myeloma cells are those derived from warm-blooded animals such as NS-1, P3U1, SP2/0, AP-1, etc. In particular, P3U1 is preferably used. A preferred ratio of the count of the antibody-producing cells used (spleen cells) to the count of myeloma cells is within a range of approximately 1:1 to 20:1. When PEG (preferably, PEG 1000 to PEG 6000) is added at a concentration of approximately 10 to 80% followed by incubation at 20 to 40° C., preferably at 30 to 37° C. for 1 to 10 minutes, an efficient cell fusion can be performed.

Various methods can be used for screening of monoclonal antibody-producing hybridomas. Examples of such methods include a method which comprises adding the supernatant of a hybridoma to a solid phase (e.g., a microplate) adsorbed with the protein as an antigen directly or together with a carrier, adding an anti-immunoglobulin antibody (where mouse cells are used for the cell fusion, anti-mouse immunoglobulin antibody is used) labeled with a radioactive substance or an enzyme or Protein A and detecting the monoclonal antibody bound to the solid phase, and a method which comprises adding the supernatant of hybridoma to a solid phase adsorbed with an anti-immunoglobulin antibody or Protein A, adding the protein labeled with a radioactive substance or an enzyme and detecting the monoclonal antibody bound to the solid phase, or the like.

The monoclonal antibody can be screened according to known methods or their modifications. Usually, the screening can be effected in a medium for animal cells supplemented with HAT (hypoxanthine, aminopterin and thymidine). Any screening and growth medium can be employed as far as the hybridoma can grow there. For example, RPMI 1640 medium containing 1% to 20%, preferably 10% to 20% fetal bovine serum, GIT medium (Wako Pure Chemical Industries, Ltd.) containing 1 to 10% fetal bovine serum, a serum free medium for cultivation of a hybridoma (SFM-101, Nissui Seiyaku Co., Ltd.) and the like can be used for the screening and growth medium. The culture is carried out generally at 20° C. to 40° C., preferably at 37° C., for about 5 days to about 3 weeks, preferably 1 to 2 weeks, usually under 5% $CO_2$. The antibody titer of the culture supernatant of a hybridoma can be determined in the same manner as in the assay antibody titer in antisera described above.

(b) Purification of Monoclonal Antibody

Separation and purification of a monoclonal antibody can be carried out by known methods, such as separation and purification of immunoglobulins [for example, salting-out, alcohol precipitation, isoelectric point precipitation, electrophoresis, adsorption and desorption with ion exchangers (e.g., DEAE), ultracentrifugation, gel filtration, or a specific purification method which comprises collecting only an antibody with an activated adsorbent such as an antigen-binding solid phase, Protein A or Protein G and dissociating the binding to obtain the antibody.]

[Preparation of Polyclonal Antibody]

The polyclonal antibody of the present invention can be manufactured by known methods or modifications thereof. For example, a warm-blooded animal is immunized with an immunogen (protein antigen) per se, or a complex of immunogen and a carrier protein is formed and a warm-blooded animal is immunized with the complex in a manner similar to the method described above for the manufacture of monoclonal antibodies. The product containing the antibody to the protein of the present invention is collected from the immunized animal followed by separation and purification of the antibody.

In the complex of immunogen and carrier protein used to immunize a warm-blooded animal, the type of carrier protein and the mixing ratio of carrier to hapten may be any type and in any ratio, as long as the antibody is efficiently produced to the hapten immunized by crosslinking to the carrier. For example, bovine serum albumin, bovine thyroglobulin or hemocyanin is coupled to hapten in a carrier-to-hapten weight ratio of approximately 0.1 to 20, preferably about 1 to about 5.

A variety of condensation agents can be used for the coupling of carrier to hapten. Glutaraldehyde, carbodiimide, maleimide activated ester and activated ester reagents containing thiol group or dithiopyridyl group are used for the coupling. The condensation product is administered to warm-blooded animals either solely or together with carriers or diluents to the site that can produce the antibody by the administration. In order to potentiate the antibody productivity upon the administration, complete Freund's adjuvant or incomplete Freund's adjuvant may be administered. The administration is usually performed once every 2 to 6 weeks and 3 to 10 times in total.

The polyclonal antibody can be collected from the blood, abdominal dropsy, etc., preferably from the blood, of warm-blooded animal immunized by the method described above.

The polyclonal antibody titer in antiserum can be assayed by the same procedure as that for the determination of serum antibody titer described above. The separation and purification of the polyclonal antibody can be carried out following the method for the separation and purification of immunoglobulins performed as in the separation and purification of monoclonal antibodies described hereinabove.

An antibody which specifically recognizes a polypeptide corresponding to the whole or a part of the intracellular EphA4 sequence may be prepared by the method described below.

For example, when it is intended to obtain an antibody with a higher binding affinity than those antibodies recognizing full-length EphA4 polypeptide, an animal is immunized with the whole or a part of the intracellular EphA4 sequence. After confirmation of rise in antibody titer, antisera are collected and affinity-purified with the peptide used in immunization.

When it is intended to obtain an antibody that does not recognize EphA4 polypeptide undegraded by γ-secretase but recognizes a polypeptide corresponding to the whole of a part of the intracellular EphA4 sequence, an animal is immunized with an EphA4 peptide cleaved by γ-secretase (hereinafter, referred to as "cleaved peptide") and the resultant antisera are collected. The antisera are reacted with EphA4 peptide not cleaved by γ-secretase (hereinafter, referred to as "uncleaved peptide") followed by removal of those antibodies reacting with uncleaved peptide. Subsequently, by purifying with the cleaved peptide, an antibody that does not recognize uncleaved peptide but recognizes cleaved peptide is purified.

The antisense DNA having a complementary or substantially complementary nucleotide sequence to the DNA or mRNA encoding the protein or the partial peptide of the present invention may be any antisense DNA, as long as it has a nucleotide sequence complementary or substantially complementary to that of the DNA or mRNA of the present invention and is an oligonucleotide or its derivative capable of inhibiting expression of the protein or partial peptide.

The nucleotide sequence substantially complementary to the DNA or mRNA may be, for example, a nucleotide sequence having at least about 40% homology, preferably at least about 60% homology, more preferably at least about 80% homology and still more preferably at least about 90% homology, to the full-length nucleotide sequence or partial nucleotide sequence of the nucleotide sequence complementary to the DNA or mRNA of the present invention (i.e., complementary strand to the DNA or mRNA of the present invention), and the like. In the entire nucleotide sequence of the complementary strand to the DNA or mRNA of the present invention, an antisense DNA having at least about 40% homology, preferably at least about 60% homology, more preferably at least about 80% homology and still more preferably at least about 90% homology, to the complementary strand of the nucleotide sequence which encodes an N-terminal region of the protein of the present invention (e.g., the nucleotide sequence around the initiation codon). These antisense DNAs can be synthesized using a known DNA synthesizer, etc.

The intracellular EphA4 of the present invention has such effects as Rac activity (especially Rac1 activity) and spine formation activity. Therefore, the intracellular EphA4 of the present invention is applicable to various uses.

Hereinbelow, uses of the intracellular EphA4 of the present invention (hereinafter, sometimes just referred to as the "protein of the present invention"), polynucleotides of the present invention encoding the intracellular EphA4 (hereinafter, sometimes referred to as the "DNA of the present invention"), antibodies to the intracellular EphA4 (hereinafter, sometimes referred to as the "antibody of the present invention") and antisense DNA.

(1) Medicines such as Therapeutic and Prophylactic Agents for Various Diseases

When Rac activation or spine formation in cells is insufficient or abnormal in a patient because the in vivo processing of EphA4 by γ-secretase is reduced or deficient, it is possible to allow the role of the protein of the present invention to be exerted sufficiently or normally (a) by administering the DNA of the present invention to the patient to thereby express the protein of the present invention in vivo, (b) by inserting the DNA of the present invention into a cell, allowing the expressing of the protein of the present invention and then transplanting the cell into the patient, (c) by administering the protein of the present invention to the patient, or the like.

Therefore, the protein and the DNA of the present invention are useful as medicines, such as therapeutic and prophylactic agents for dementia (especially AD).

Where the DNA of the present invention is used as the therapeutic/prophylactic agents described above, the DNA alone may be administered directly to human or other warm-blooded animals; alternatively, the DNA may be inserted into an appropriate vector such as retrovirus vector, adenovirus vector, adenovirus-associated virus vector, etc. and then administered to human or other warm-blooded animals in a conventional manner. The DNA of the present invention may be administered as it is, or may be formulated with adjuvants to assist its uptake and then administered by gene gun or through a catheter such as a hydrogel catheter.

When the protein of the present invention is used as the above-mentioned therapeutic/prophylactic agent, it is preferred that the protein is at least 90%, preferably at least 95%, more preferably at least 98% and still more preferably at least 99% purified.

When the protein of the present invention is used as the above-mentioned therapeutic/prophylactic, it may be used orally, for example, in the form of tablets which maybe sugar coated if necessary, capsules, elixirs, microcapsules, etc., or parenterally in the form of injectable preparations such as a sterile solution or a suspension in water or with other pharmaceutically acceptable liquid. These preparations can be prepared by mixing the protein or DNA of the present invention with a physiologically acceptable known carrier, a flavoring agent, an excipient, a vehicle, an antiseptic agent, a stabilizer, a binder, etc. in a unit dosage form required in a generally accepted manner applied to the manufacturing of pharmaceutical preparations. The active ingredient in the preparation is controlled in such a manner that an appropriate dose is obtained within the specified range given. When the DNA of the present invention is used, the DNA alone or the DNA inserted into an appropriate vector such as retrovirus vector, adenovirus vector, adenovirus-associated virus vector, etc. may be used in such preparations according to conventional methods.

Additives miscible with tablets, capsules, etc. include a binder such as gelatin, corn starch, tragacanth and gum arabic, an excipient such as crystalline cellulose, a swelling agent such as corn starch, gelatin and alginic acid, a lubricant such as magnesium stearate, a sweetening agent such as sucrose, lactose and saccharin, and a flavoring agent such as peppermint, akamono (*Gaultheria ovatifolia* ssp. *adenothrix*) oil or cherry. When the intended unit dosage form is capsule, liquid carriers such as oils and fats may further be used together with the additives described above. A sterile composition for injection may be formulated according to a conventional manner used to make a pharmaceutical, e.g., by dissolving or suspending the active ingredients in a vehicle such as water for injection with a naturally occurring vegetable oil such as sesame oil and coconut oil, etc. to prepare the pharmaceutical. Examples of an aqueous medium for injection include physiological saline and an isotonic solution containing glucose and other auxiliary agents (e.g., D-sorbitol, D-mannitol, sodium chloride, etc.) and may be used in combination with an appropriate dissolution aid such as an alcohol (e.g., ethanol, etc.), a polyalcohol (e.g., propylene glycol and polyethylene glycol), a nonionic surfactant (e.g., polysorbate 80™, HCO-50, etc.), and the like. Examples of the oily medium include sesame oil, soybean oil, etc., which may also be used in combination with a dissolution aid such as benzyl benzoate, benzyl alcohol, etc. The agent may further be formulated with a buffer (e.g., phosphate buffer, sodium acetate buffer, etc.), a soothing agent (e.g., benzalkonium chloride, procaine hydrochloride, etc.), a stabilizer (e.g., human serum albumin, polyethylene glycol, etc.), a preservative (e.g., benzyl alcohol, phenol, etc.), an antioxidant, etc. The thus-prepared liquid for injection is normally filled in appropriate ampoules.

The vector into which the DNA of the present invention is inserted may also be prepared into pharmaceutical preparations in a manner similar to the procedures above. Such preparations are usually used parenterally.

Since the thus obtained pharmaceutical preparations are safe and of low toxicity, the preparations can be administered to human or other warm-blooded animals (e.g., rat, mouse, guinea pig, rabbit, sheep, pig, cattle, horse, cat, dog, monkey, etc.).

The dose of the protein of the present invention varies depending on target disease, subject to be administered, route for administration, etc.; for example, in oral administration for the treatment of AD, the dose of the protein of the present invention is generally about 0.1 mg to about 100 mg, preferably about 1.0 to about 50 mg, and more preferably about 1.0 to about 20 mg per day for adult (60 kg body weight). In parenteral administration, the single dose varies depending on subject to be treated, target disease, etc. but it is convenient for the treatment of AD to administer the protein intravenously at a daily dose of about 0.01 to about 30 mg, preferably about 0.1 to about 20 mg, and more preferably about 0.1 to about 10 mg for adult (60 kg body weight). For other animal species, the corresponding dose as converted per 60 kg body weight can be administered.

As the ninth embodiment, the present invention provides kits.

The present invention provides a kit containing a polynucleotide encoding an intracellular EphA4 polypeptide cleaved by γ-secretase and an antibody which specifically recognizes the intracellular EphA4 polypeptide.

The kit of the present invention contains a polynucleotide encoding an intracellular EphA4 polypeptide cleaved by γ-secretase and an antibody which specifically recognizes the intracellular EphA4 polypeptide. Further, the kit may also contain tools used in microscopic observation, immunoblotting or Western blotting (e.g., reaction vessels, blotting membranes, etc.), reagents (e.g., buffers, culture broths, etc.), instructions, and so on.

The present invention provides a kit containing an intracellular EphA4 polypeptide cleaved by γ-secretase and an antibody which specifically recognizes the intracellular EphA4 polypeptide.

The kit of the present invention contains an intracellular EphA4 polypeptide cleaved by γ-secretase and an antibody which specifically recognizes the intracellular EphA4 polypeptide. Further, the kit may also contain tools used in microscopic observation, immunoblotting or Western blotting (e.g., reaction vessels, blotting membranes, etc.), reagents (e.g., buffers, culture broths, etc.), instructions, and so on.

The present invention provides a test kit for measuring the processing of EphA4 by γ-secretase and a test kit for measuring spine formation by γ-secretase.

The kit of the present invention contains γ-secretase or a biological composition containing the same, and a biological composition containing EphA4. The kit may further contain a substrate for γ-secretase other than EphA4 (e.g., APP and/or Notch) or a biological composition containing such a substrate. Preferably, the kit contains a plurality of substrates for γ-secretase. It is preferred that the kit contains APP and/or Notch in addition to EphA4. Further, the kit contains tools used in immunoblotting or Western blotting (e.g., reaction vessels, blotting membranes, etc.), reagents (e.g., buffers, culture broths, anti-EphA4 antibodies, etc.), instructions, and so on.

The present invention provides a test kit for measuring spine formation by γ-secretase-cleaved intracellular EphA4 and a test kit for measuring Rac activity mediated by γ-secretase-cleaved intracellular EphA4.

The kit of the present invention contains an intracellular EphA4 polypeptide cleaved by γ-secretase. Further, the kit may also contain tools used in microscopic observation, immunoblotting or Western blotting (e.g., reaction vessels, blotting membranes, etc.), reagents (e.g., buffers, culture broths, anti-intracellular EphA4 antibodies, etc.), instructions, and so on.

EXAMPLES

Hereinbelow, the present invention will be described in more detail with reference to the following Examples and Preparation Examples. However, the present invention is not limited to these Examples, which are provided only for the purpose of full disclosure of the present invention to those skilled in the art. It is not meant or even implied that the experiments described herein are all or only one experiment actually carried out. Although efforts have been made to guarantee the accuracy of the numerical values used herein (e.g., volume/weight, temperature, concentration, etc.), experimental errors and deviations are considered to some extent. Thus, such values may be changed within a range which does not depart from the scope of the present invention.

Example 1

Analysis of EphA4 Processing in EphA4-Transfected 294/EBNA-1 Cell Strain

Whether or not EphA4 is a substrate for γ-secretase was evaluated using HEK293 cells expressing EphA4 with an HA tag added to its C-terminus, in the presence of a γ-secretase inhibitor. As the γ-secretase inhibitor, (2S)-2-{[(3,5-difluorophenyl)acetyl]amino}-N-[(3S)-1-methyl-2-oxo-5-phenyl-2,3-dihydro-1H-1,4-benzodiazepin-3-yl]propanamide (hereinafter, sometimes referred to as "Compound E") (Alexis Biochemicals) was used.

1. Experimental Conditions and Methods (1) Cloning of Rat EphA4

RNA was purified from rat brain with Trisol (Invitrogen), followed by synthesis of 1st strand cDNA with RNA PCR Kit (TaKaRa). Using 1 µl of the finally synthesized 1st strand cDNA product, rat EphA4 was amplified with the following primers and Pfu (Stratagene):

```
Primer1 XhoJ site-added:
                                    (SEQ ID NO: 204)
GAGCTCGAGGCCACCATGGCTGGGATTTTCTATTTCATC Primer2 NotI site-added:
                                    (SEQ ID NO: 205)
GAGGCGGCCGCGACAGGAACCATCCTGCCATGCATC
```

PCR conditions were as follows: first reaction at 95° C. for 2 minutes; then 35 cycles of (at 95° C. for 45 seconds→mat 60° C. for 45 seconds→at 72° C. for 6 minutes); then final reaction at 72° C. for 10 minutes. The PCR product was purified with Quiaquick PCR purification kit (QIAGEN), treated with restriction enzymes XhoI (TaKaRa) and NotI (TaKaRa) and then cloned into pBluescript (Stratagene).

(2) Construction of a Gene Encoding Rat EphA4 with HA Tag Added to its C-Terminus and an Expression Vector pcDNA (Invitrogen) was treated with restriction enzymes XhoI (TaKaRa) and NotI (TaKaRa). EphA4 obtained by treating the pBluescript obtained in (1) above with restriction enzymes XhoI (TaKaRa) and NotI (TaKaRa) was inserted into the resultant pcDNA to thereby prepare an expression vector. This expression vector was constructed so that an HA tag is added to the C-terminus of the incorporated EphA4. The DNA sequence of the resultant EphA4-HA was analyzed with a DNA sequencer (Applied Biosystems Model 3130×1). The resultant DNA sequence is shown below. Compared with the DNA sequence of rat EphA4 (XM__244186.4), the base at position 861 was changed from c to t (hereinafter, this mutation is expressed as "c→t". Other mutations are also expressed in the same manner). Further, the resultant DNA sequence was also different from the rat EphA4 (XM__244186.4) in the following points: a→t mutation at position 1110, a→g mutation at position 1278, a→g mutation at position 1320, c→t mutation at position 1623, c→t mutation at position 1626, c→t mutation at position 2208 and c→t mutation at position 2265. However, it was confirmed that these sequences were 100% identical at the amino acid level. This expression vector was prepared in large quantity with Endofree Plasmid Maxi Kit (QIAGEN).

EphA4-HA DNA Sequence (SEQ ID NO: 3)

In the nucleotide sequence as shown in SEQ ID NO: 3, the sequence spanning from g at position 2968 to t at position 2997 encodes an HA tag.

EphA4-HA Amino Acid Sequence (SEQ ID NO: 4)

(3) Cells Expressing a Gene Encoding Rat EphA4 with HA Tag Added to its C-Terminus 293/EBNA-1 cell strain (Invitrogen) was cultured in 10% FEB (Hyclone)/DMEM (Invitrogen) under 5% $CO_2$ at 37° C., followed by transfection thereinto of a gene encoding rat EphA4 with an HA tag added to its C-terminus with Lipofectamine 2000 (Invitrogen). After one day culture under the same conditions, 50 nM Compound E (Alexis Biochemicals) was added to the medium. Cells were cultured for another day under the same conditions. Then, the transfected HEK293 cells were collected with PBS (Sigma) and sonicated with a sonicator (Taitec VP-5S) to disrupt cells. Then, the quantity of protein was determined with Protein Assay Kit (BioRad). Samples (2 µg each), which were obtained from Compound E-added cells and Compound E-not added cells respectively, were subjected to SDS-PAGE, followed by Western blotting with an anti-HA antibody (Roche) (final concentration: 0.2 µg/ml).

2. Experimental Results

FIG. 1 shows the results.

In FIG. 1, the left lane represents the sample untreated with Compound E and the right lane represents the sample treated with Compound E. "Full" represents the full-length of EphA4. "CTF" (C-terminal fragment) represents a region spreading from the transmembrane domain of EphA4 to its C-terminal site. When Compound E was added, a band around 50 kDa (CTF) was accumulated specifically. Since this band is equal in size to the region spreading from the transmembrane domain of EphA4 to its C-terminal site, it has become clear that EphA4 is cleaved by γ-secretase in HE 93 cells.

First, the substrate for γ-secretase is cut off its extracellular domain by other protease. Then, γ-secretase further cuts off the transmembrane domain from the resultant digest fragment CTF [from the transmembrane domain (amino acid residue at position 547) to the C-terminus]. The final degradation product (intracellular domain) is rapidly degraded by proteasome. Since reactions proceed very quickly from the first cleavage to the final degradation by proteasome, the substrate is detected as a single band when detected by Western blotting. However, it has been found that accumulation of CTF is detected specifically when the substrate is treated with γ-secretase inhibitor.

Example 2

Analysis of EphA4 Processing in Primary Culture of Rat Hippocampal Neurons

Whether or not EphA4 is a substrate for γ-secretase was evaluated using a primary culture of rat hippocampal neurons in the presence of a γ-secretase inhibitor. As the γ-secretase inhibitor, (2S)-2-{[(3,5-difluorophenyl)acetyl]amino}-N-[(3S)-1-methyl-2-oxo-5-phenyl-2,3-dihydro-1H-1,4-benzodiazepin-3-yl]propanamide (Compound E) (Alexis Biochemicals) was used.

1. Experimental Conditions and Methods

The hippocampus was isolated from embryonic day 18 SD rats (Charles River) and subjected to culture. Specifically, embryos were removed aseptically from pregnant rats under etherization. The brain was removed from each embryo and dipped in 20% FBS (Hyclone)/HBSS (Sigma). The hippocampus was collected from the thus obtained brain under a stereomicroscope. The collected hippocampus was treated in an enzyme solution containing 0.25% trypsin (Invitrogen) and 0.5 mg/ml DNase (Sigma) at 35° C. for 10 minutes to disperse cells. This enzyme reaction was terminated by adding 20% FBS (Hyclone)/HBSS (Sigma). Then, 2 ml of HBSS (Sigma) was added to the resultant cells. The HBSS-added cell mass was re-dispersed by gentle pipetting. The resultant neuron suspension was diluted with a medium and plated in 10 cm dishes at an initial cell density of $1.5 \times 10^6$ cells/dish. As the medium, MEM medium (Invitrogen) supplemented with 10% FBS (Hyclone), 1X B27 Supplement (Invitrogen, 2 mM L-glutamine (Invitrogen) and 25 µg/ml insulin (Sigma) was used. The plated cells were cultured in an incubator under 5% $CO_2$ and 95% air at 37° C. for 3 days. Then, a half volume of the medium was exchanged with a cytosine β-D-arabinofuranoside hydrochloride (AraC)-containing medium in order to inhibit the growth of glial cells. As the AraC-containing medium, MEM medium (Invitrogen) supplemented with 5% FBS (Hyclone), 1X B27 Supplement (Invitrogen), 0.5 mM L-glutamine (Invitrogen), 25 µg/ml insulin (Sigma) and 8 µM AraC (Sigma) was used. Two weeks after the start of culture, Compound E (final concentration: 50 nM) was added, and the cells were cultured for another week. Then, cells were collected with PBS and subjected to quantitative determination of protein. Protein samples (10 µg each) were subjected to SDS-PAGE and Western blotting with an anti-EphA4 antibody (Upstate) (1/500 dilution).

2. Experimental Results

Figure 2:
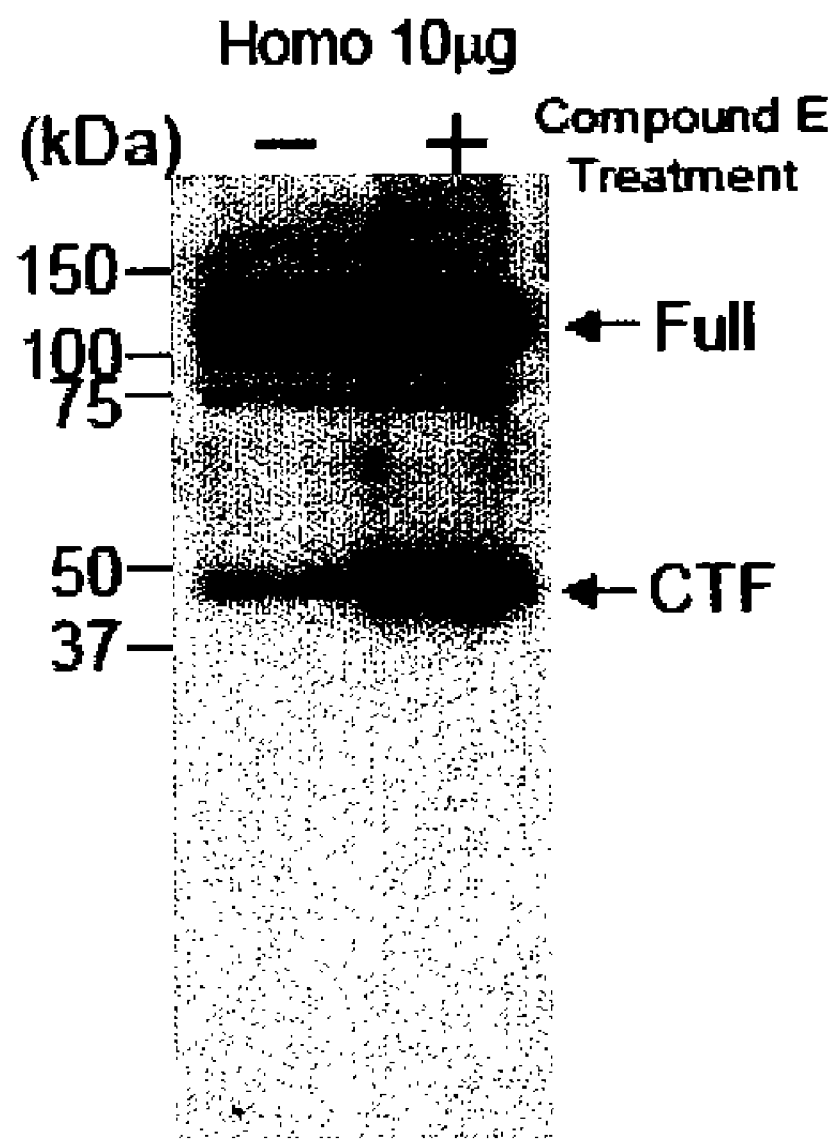
FIG. 2 shows the results of analysis of EphA4 processing using primary culture of rat hippocampal neurons.

FIG. 2 shows the results.

In FIG. 2, the left lane represents the sample untreated with Compound E and the right lane represents the sample treated with Compound E. "Full" represents the full-length of EphA4 before degradation. "CTF" represents a region spanning from the transmembrane domain of EphA4 to its C-terminal site. When Compound E was added, a band around 50 kDa (CTF) was accumulated specifically. Since this band is equal in size to the region spreading from the transmembrane domain of EphA4 to its C-terminal site, it has become clear that EphA4 is cleaved by γ-secretase in hippocampal neurons.

Example 3

Identification of EphA4 Cleavage Site by γ-Secretase Using Mass Spectrometry

The site at which EphA4 is cleaved by γ-secretase was analyzed and identified.

1. Experimental Conditions and Methods

293/EBNA-1 cell strain (Invitrogen) was cultured in 10% FBS (Hyclone)/DMEM (Invitrogen) under 5% $CO_2$ at 37° C. A gene encoding a rat EphA4 polypeptide in which a signal sequence has been added to the N-terminus of 529-stop and an HA tag has been added to the C-terminus (SEQ ID NO: 199) was transfected to the cells with Lipofectamine 2000 (Invitrogen). After cultured for one day under the same conditions, the cells were harvested with a buffer containing 50 mM PIPES, 5 mM $MgCl_2$, 5 mM $CaCl_2$ and 150 mM KCl, and then homogenated appropriately to disrupt cell membranes. Subsequently, the resultant homogenate was centrifuged to remove nuclear fraction. The resultant supernatants were further ultra-centrifuged to separate cytosolic fraction from cell membrane fraction. The cell membrane fraction was suspended in the same buffer as used for harvesting cells and left for 2 hours at 37° C. During this time period, EphA4 cleavage reaction by γ-secretase proceeded, resulting in accumulation of cleaved fragments in the buffer. After the reaction, the reaction solution was ultra-centrifuged. The resultant supernatant was subjected to immunoprecipitation with anti-HA antibody. Thus, EphA4 fragments cleaved by γ-secretase were obtained. The resultant EphA4 fragments were subjected to SDS-PAGE. Gel sections containing bands detected with anti-HA antibody were cut out and subjected to mass spectroscopy.

Prior to mass spectroscopy, the gel sections were digested as described below. Briefly, proteins were reduced with DTT (Calbiochem) in the gel and cystein residues were alkylated with iodoacetamide (WAKO). Subsequently, the proteins were fragmented with trypsin (Promega) at 37° C. overnight, followed by extraction of peptides. The resultant peptide mixture was desalted with Empore C18-HD membrane (3M) and subjected to LC-MS/MS analysis. This analysis was performed using a prominence pump for Shimadzu high performance liquid chromatograph (Shimadzu Corp.), HTC-PAL autosampler (CTC Analytics) and Orbitrap-XL mass spectrometry equipment (Thermofisher). For peptide isolation and electrospray, a home made sprayer (100 μm inside diameter, 6 μm caliber) filled with ReproSil-Pur C18 (Dr. Maisch GmbH) was used. LC-MS/MS mobile phase A was 0.2% acetic acid; mobile phase B was 0.2% acetic acid, 80% acetonitrile. For identification of peptides and proteins, automatic database search and analysis were performed with NCBInr and EphA4 database using GPM (The Grobal Proteome Machine Organization).

```
Signal Sequence + Cloning Site + 529-stop + HA DNA
Sequence
                                       (SEQ ID NO: 199)
ATGTCTGCACTTCTGATCCTAGCTCTTGTTGGAGCTGCAGTTGCTGGATC GGAATTCACGCGTGTCGAGgtcactaccaatacagtgccttcccgaatca ttggtgatggggccaactctaccgtcctgctggtctccgtctctggcagt gtagtactcgtggtcattctcattgcggcatttgtgatcagccgtagacg gagtaagtacagccaagcaaagcaagaagcagatgaagagaagcatttga atcaaggtgttagaacatacgtggatcccttt acatatgaagaccccaac caggcagttcgagaatttgccaaagaaatcgatgcctcctgcattaaaat cgaaaaggtcattggagttggcgaatttggagaagtctgcagtgggcgtc tcaaagtgcccggcaagagagagatctgtgtggccatcaagactctgaaa gctggttatactgacaagcagaggagagacttcctgagcgaggccagcat catgggacagtttgaccacccaaacataatccacctggaaggcgttgtca ccaaatgtaaaccagtaatgatcatcacggagtacatggagaacggctcc ttggacgctttcctcaggaagaatgatggccgatttacagtcattcagct ggtgggcatgctccgaggcattggctcggggatgaagtatttatctgata tgagctatgtgcatcgagacctggctgccaggaacattctggtaaatagc aacttggtctgcaaggtgtctgatttcggcatgtccagggtgcttgagga tgacccggaagcagcctatactaccaggggcggcaagattcccatccggt ggactgcaccagaagcaattgcgtatcgtaaatttacctcagccagtgac gtctggagctacggaatcgttatgtgggaagtgatgtcatatggagagag gccgtactgggatatgtccaatcaagatgtgatcaaagccatcgaggaag ggtaccggctaccccgccaatggactgccccattgcctccatcagtta atgctggactgttggcagaaagagagaagcgacaggcctaaatttgggca gatcgtcaacatgttggacaaactcatccgcaacccaacagcctgaaga ggacagggccagagagttccagaccaaacacagccttgttagatcccagc tccctgaattctccgccgtagtatcagtgggtgactggctgcaggccat caaaatggaccggtataaggacaacttcacagccgccgggtacacgacac tagaagctgtggttcacatgagccaggatgacctggcgcgaattggcatc accgcaatcacgcaccagaataagatttttgagcagcgtccaggcgatgcg aacccagatgcagcagatgcatggcaggatggttcctgtcGCGGCCGCAA

TGGACTACCCATACGACGTCCCAGACTACGCTTAG
```

2. Experimental Results

Figure 3:
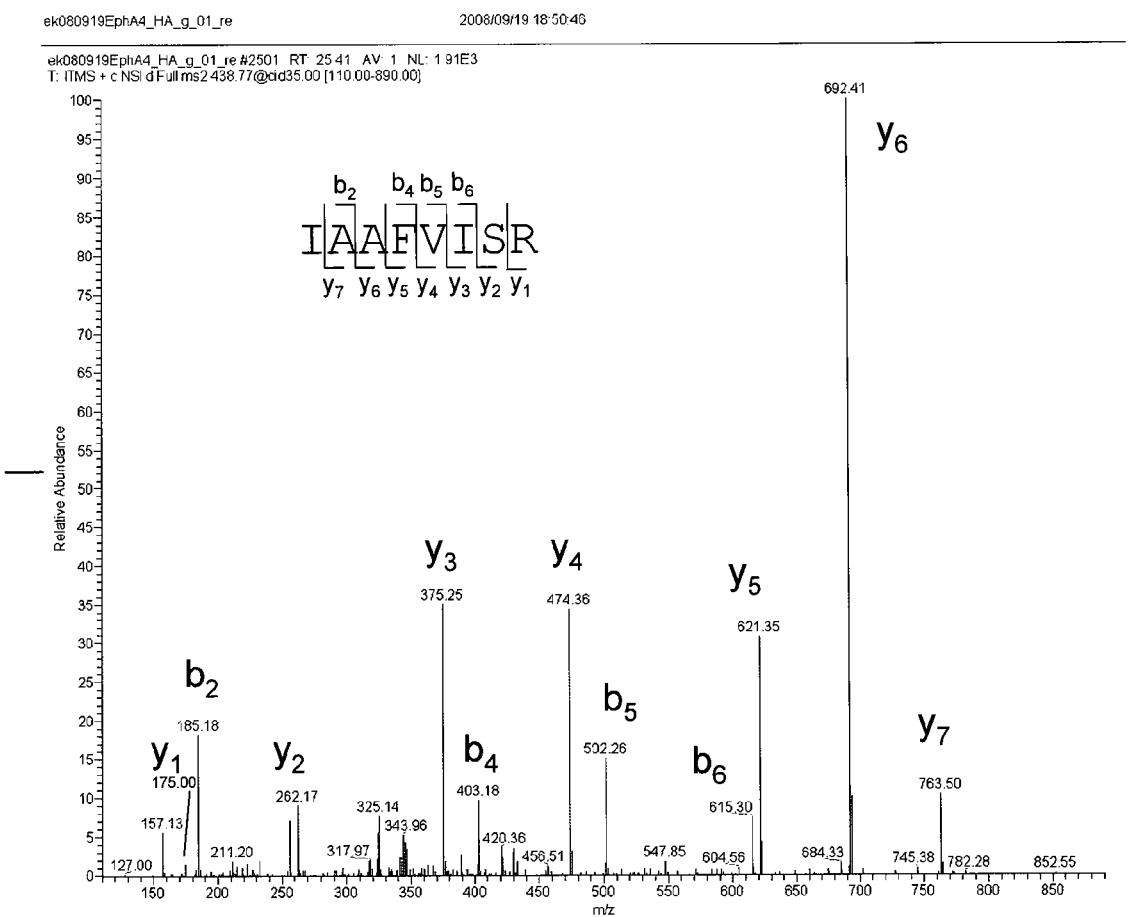
FIG. 3 is a diagram showing the results of identification of the EphA4 cleavage site by γ-secretase using mass spectrometry.

As a result of LC-MS/MS analysis, peptides with a cleavage site were found. The sequences thereof were confirmed from tandem mass spectra (see FIG. 3) and the cleavage site was identified. These results revealed that EphA4 is cleaved between leucine (L) at position 563 and isoleucine (I) at position 564 of SEQ ID NO: 2.

Example 4

Spine Formation Analysis by Overexpression of EphA4 Intracellular Fragment

The intracellular fragment of EphA4 is cut out by γ-secretase. In order to clarify the physiological meaning of production of the intracellular fragment by γ-secretase, an expression vector for the intracellular fragment of EphA4 was constructed, followed by analysis of the effect of the intracellular fragment upon spine formation.

1. Experimental Conditions and Methods (1) Construction of EphA4 Intracellular Fragment Expression Vector Using rat EphA4 cDNA as a template, a region corresponding to the intracellular domain of EphA4 (from amino acid at position 571 to stop) was amplified with the following primers and Pfu (Stratagene):

primer3 XhoI site added: GAGCTCGAGCGTAGACGGAG-TAAGTACAGCCAA (SEQ ID NO: 206), primer2

PCR conditions were as follows: first reaction at 95° C. for 2 minutes; then 25 cycles of (at 95° C. for 45 seconds→at 60° C. for 45 seconds→at 72° C. for 4 minutes); then final reaction at 72° C. for 7 minutes. The PCR product was purified with Quiaquick PCR purification kit (QIAGEN), treated with restriction enzymes XhoI (TaKaRa) and NotI (TaKaRa) and then cloned into pBluescript (Stratagene). The DNA sequence was confirmed with a DNA sequencer (Applied Biosystems; 3130×1).

pCAG (SEQ ID NO: 202) was treated with restriction enzymes XhoI (TaKaRa) and NotI (TaKaRa). The intracellular fragment was cut out with XhoI (TaKaRa) and NotI (TaKaRa) from the pBluescript obtained above, and inserted into the pCAG. pCAG may be prepared based on the disclosure in Gene 108, 193-200 (1991) and Japanese Patents Nos. 2824433 and 2824434. The EphA4 intracellular fragment expression vector was constructed so that an HA tag is added to the N-terminus of the integrated intracellular fragment.

pCAG DNA Sequence (SEQ ID NO: 202)

HA-EphA4 Intracellular Fragment DNA Sequence (SEQ ID NO: 93)

In the nucleotide sequence of SEQ ID NO: 93, a sequence spanning from a at position 1 at the 5' end to g at position 45 encodes HA tag; the remaining sequence starting at position 46 encodes EphA4 intracellular fragment.

HA-EphA4 Intracellular Fragment Amino Acid Sequence (SEQ ID NO: 94)

(2) Transfer of the Gene Encoding EphA4 Intracellular Fragment

Primary culture of rat hippocampal neurons were cultured in the same manner as described in Example 2. On day 9 of culture, gene transfer experiment was performed using Lipofectamine 2000 (Invitrogen) according to the manual. In order to visualize the morphology of spines, pcDNA3.1Syn1 GFP (SEQ ID NO: 306) was co-transferred into the neurons. Twelve days after the gene transfer, the neurons were fixed with 2% paraformaldehyde, treated with 0.25% TritonX-100 and blocked with BlockAce (Snow Brand Milk). After the blocking, the neurons were treated with rabbit anti-GFP antibody (Invitrogen) and rat anti-HA antibody (Roche); and reacted with FITC-linked anti-rabbit IgG antibody (Jackson), Cy3-linked anti-mouse IgG antibody (Jackson) and Cy5-linked anti-rat IgG antibody (Jackson). Stained samples prepared were observed under a confocal laser scanning microscope (LSM510). The spines (protuberances formed on dendrites) which were visualized by the expression of GFP were counted. Image data were quantitatively determined with image analysis software Metamorph (Molecular Devices). pcDNA3.1Syn1 GFP may be obtained by the procedures described below.

Briefly, Synapsin-1 promoter sequence was obtained by amplifying a nucleotide chain comprising Synapsin-1 promoter sequence by PCR using pDRIVE-Synapsin plasmid vector (Invitrogen) as a template. CMV promoter in pcDNA3.1 (+) plasmid vector (Invitrogen) was cut out by restriction enzyme treatment and replaced with the Synapsin-1 promoter by the ligation method, to thereby prepare pcDNA3.1Syn1 plasmid vector. EGFP sequence was obtained by amplifying a nucleotide chain comprising EGFP sequence by PCR using pIRES2-EGFP plasmid vector (Clontech) as a template. The resultant EGFP sequence was inserted by the ligation method into the multi-cloning site located downstream of Synapsin-1 promoter in the pcDNA3.1Syn1 plasmid vector obtained above. Thus, pcDNA3.1Syn1 GFP (SEQ ID NO: 306) was prepared.

pcDNA3.1Syn1 GFP DNA Sequence (SEQ ID NO: 203)

2. Experimental Results

Figure 4:
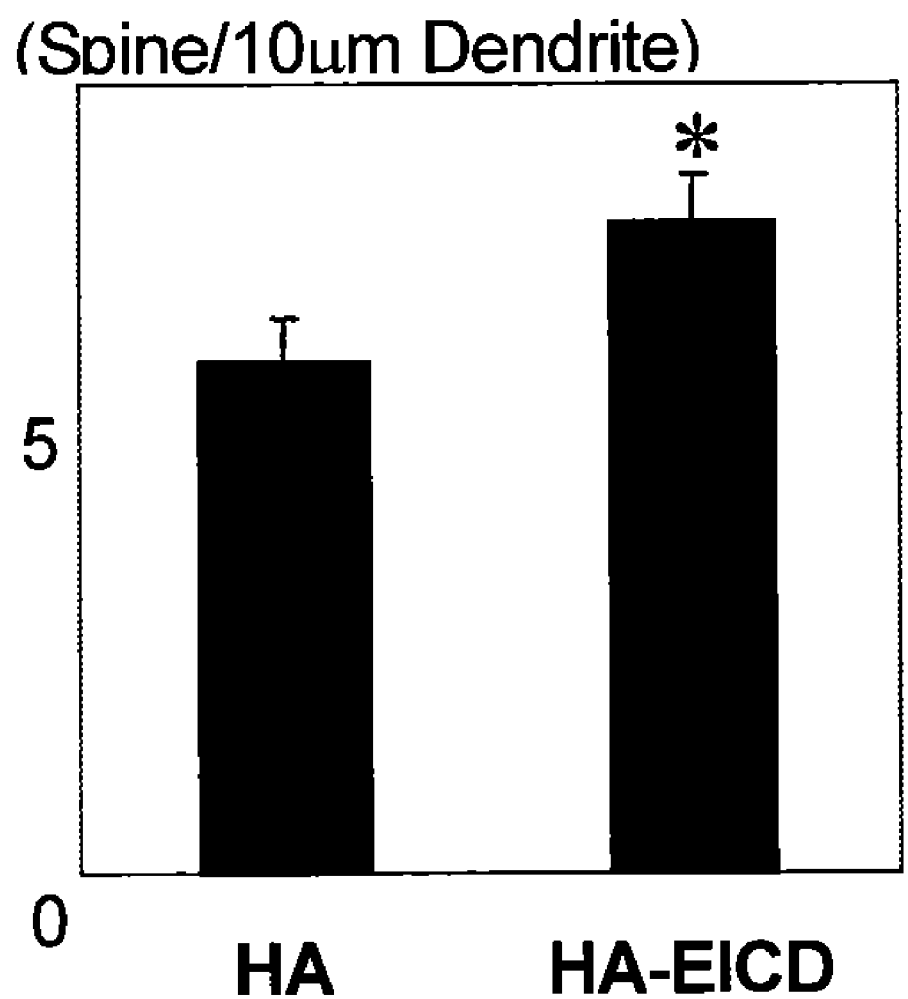
FIG. 4 shows the results of analysis of spine formation by overexpression of EphA4 intracellular fragment using primary culture of rat hippocampal neurons.

FIG. 4 shows the results.

In FIG. 4, "HA" indicates a neuron sample not transfected with any EphA4 intracellular fragment. "HA-EICD" indicates a neuron sample transfected with an EphA4 intracellular fragment. It was revealed that expression of EphA4 intracellular fragment in neurons increases the number of spines. Therefore, it has become clear that EphA4 cleaved by γ-secretase in hippocampal neurons activates spine formation.

Example 5

Spine Formation Analysis by Overexpression of EphA4 Fragment Cleaved by γ-Secretase 1. Experimental Conditions and Experimental Methods In the above-mentioned Example 4, the gene with an HA tag added to its N-terminus (SEQ ID NO:197), which is one of the two cleaved fragments, was transfected instead of the HA-EphA4 intracellular fragment and spine formation was analyzed in the same way based on the cleavage site specified in Example 3.

HA-γ-fragment DNA Sequence
(SEQ ID NO: 197)
ATGGACTACCCATACGACGTCCCAGACTACGCTACGCGT GTCGAC attgcggcatttgtgatcagccgtagacggagtaagtacagccaagcaaa gcaagaagcagatgaagagaagcatttgaatcaaggtgttagaacatacg tggatccctttacatatgaagaccccaaccaggcagttcgagaatttgcc aaagaaatcgatgcctcctgcattaaaatcgaaaaggtcattggagttgg cgaatttggagaagtctgcagtgggcgtctcaaagtgcccggcaagagag agatctgtgtggccatcaagactctgaaagctggttatactgacaagcag -continued aggagagacttcctgagcgaggccagcatcatgggacagtttgaccaccc aaacataatccacctggaaggcgttgtcaccaaatgtaaaccagtaatga tcatcacggagtacatggagaacggctccttggacgctttcctcaggaag aatgatggccgatttacagtcattcagctggtgggcatgctccgaggcat tggctcggggatgaagtatttatctgatatgagctatgtgcatcgagacc tggctgccaggaacattctggtaaatagcaacttggtctgcaaggtgtct gatttcggcatgtccagggtgcttgaggatgacccggaagcagcctatac taccaggggcggcaagattcccatccggtggactgcaccagaagcaattg cgtatcgtaaatttacctcagccagtgacgtctggagctacggaatcgtt atgtgggaagtgatgtcatatggagagaggccgtactgggatatgtccaa tcaagatgtgatcaaagccatcgaggaagggtaccggctacccccgccaa tggactgccccattgccctccatcagttaatgctggactgttggcagaaa gagagaagcgacaggcctaaatttgggcagatcgtcaacatgttggacaa actcatccgcaacccaacagcctgaagaggacagggccagagagttcca gaccaaacacagccttgttagatcccagctcccctgaattctccgccgta gtatcagtgggtgactggctgcaggccatcaaaatggaccggtataagga caacttcacagccgccgggtacacgacactagaagctgtggttcacatga gccaggatgacctggcgcgaattggcatcaccgcaatcacgcaccagaat aagattttgagcagcgtccaggcgatgcgaacccagatgcagcagatgca tggcaggatggttcctgtctga (Capital letters appearing at the 5'end of the
nucleotide sequence represent a nucleotide
sequence encoding HA tag. Small letters appearing
at the 3'end represent a nucleotide sequence
encoding EphA4 intracellular fragment cleaved by
γ-secretase.)

HA-γ-fragment Amino Acid Sequence
(SEQ ID NO: 198)
MDYPYDVPDYATRVDIAAFVISRRRSKYSQAKQEADEEKHLNQGVRTYVD

PFTYEDPNQAVREFAKEIDASCIKIEKVIGVGEFGEVCSGRLKVPGKREI

CVAIKTLKAGYTDKQRRDFLSEASIMGQFDHPNIIHLEGVVTKCKPVMII

TEYMENGSLDAFLRKNDGRFTVIQLVGMLRGIGSGMKYLSDMSYVHRDLA

ARNILVNSNLVCKVSDFGMSRVLEDDPEAAYTTRGGKIPIRWTAPEAIAY

RKFTSASDVWSYGIVMWEVMSYGERPYWDMSNQDVIKAIEEGYRLPPPMD

CPIALHQLMLDCWQKERSDRPKFGQIVNMLDKLIRNPNSLKRTGPESSRP

NTALLDPSSPEFSAVVSVGDWLQAIKMDRYKDNFTAAGYTTLEAVVHMSQ

DDLARIGITAITHQNKILSSVQAMRTQMQQMHGRMVPV

2. Experimental Results

Figure 5:
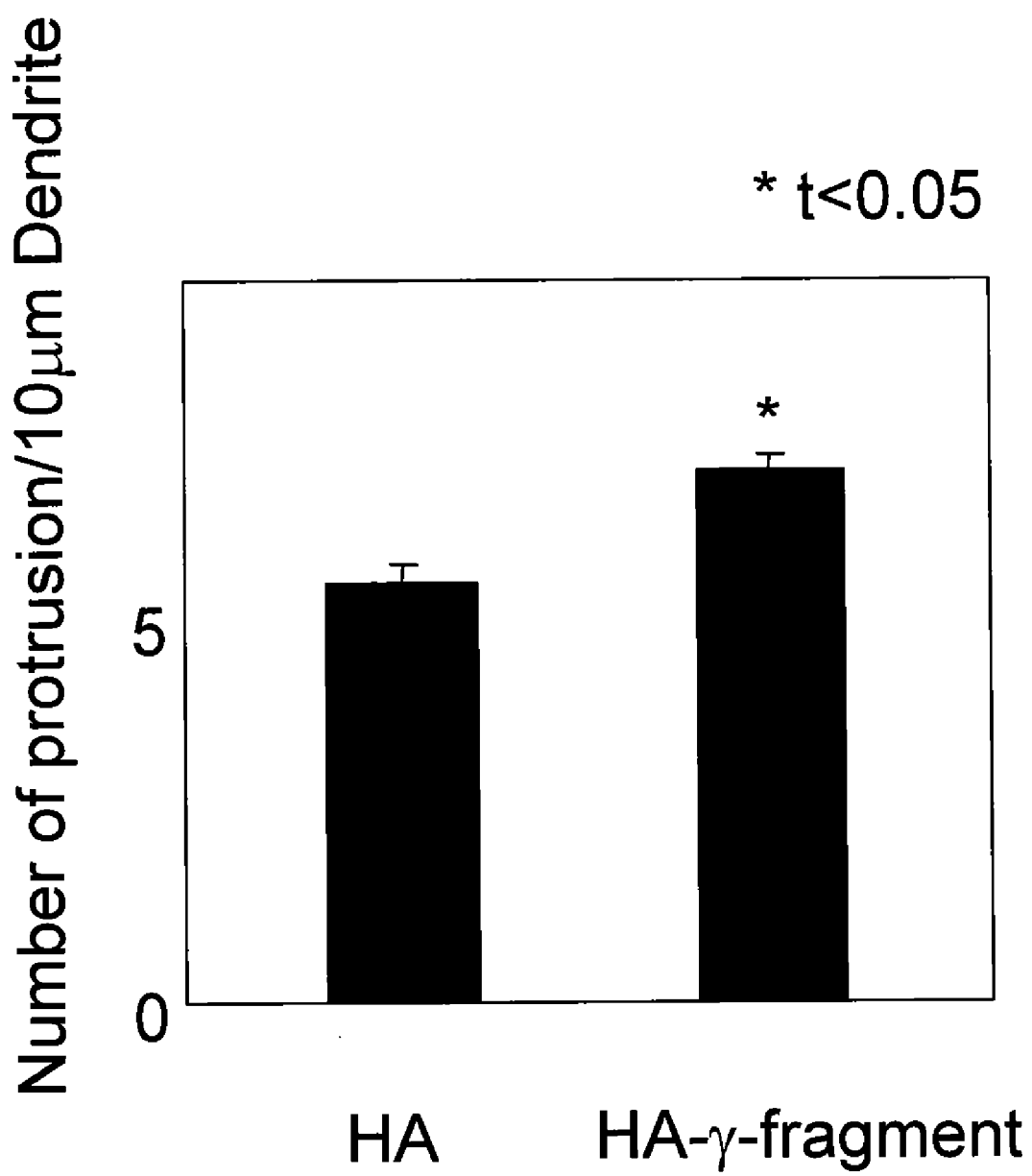
FIG. 5 shows the results of analysis of spine formation by overexpression of γ-secretase-cleaved EphA4 fragment.

FIG. 5 shows the results.

In FIG. 5, "HA" indicates a neuron sample not transfected with any EphA4 fragment cleaved by γ-secretase. "HA-γ-fragment" indicates a neuron sample transfected with an EphA4 fragment cleaved by γ-secretase. It was revealed that expression of EphA4 fragment cleaved by γ-secretase in neurons increases the number of spines. Thus, it has become clear that EphA4 intracellular fragment activates spine formation in the same manner as EphA4 fragment cleaved by γ-secretase.

Example 6

Effect of EICD upon Rho Family-Mediated Signaling Pathway

In order to examine whether or not EICD produced by γ-secretase is involved in the signaling mechanism of Rho family molecules, and activation of which molecule EICD is involved in, gene transfer into NIH3T3 cells was performed, followed by analysis of the effect of EICD in the rearrangement of actin cytoskeletons in which Rho family molecules are involved. In the rearrangement, the following facts are known: when RhoA is activated, actin fibers called stress fibers are formed at the bottom of cells; when Cdc42 is activated, protrusions called filopodia are formed; when Rac1 is activated, structures called lamellipodia are formed. The effect of EICD was examined with these formations as indicators.

1. Experimental Conditions and Experimental Methods (1) Construction of Expression Vector Using the 1st strand cDNA prepared in Example 1 as a template, rat Rac1 cDNA was amplified with the following primers and pfu (Stratagene):

```
Primer4 SalI site-added:
GAGGTCGACATGCAGGCCATCAAGTGTGTGGTG,   (SEQ ID NO: 207)

Primer5 NotI site-added:
GAGGCGGCCGCTTACAACAGCAGGCATTTTCTCT   (SEQ ID NO: 208)
```

PCR conditions were as follows: first reaction at 95° C. for 2 minutes; then 35 cycles of (at 95° C. for 45 seconds→at 60° C. for 45 seconds→at 72° C. for 2 minutes); then final reaction at 72° C. for 7 minutes. The PCR product was purified with Quiaquick PCR purification kit (QIAGEN), treated with restriction enzymes SalI (TaKaRa) and NotI (TaKaRa) and then cloned into pBluescript (Stratagene). The DNA sequence after cloning was confirmed with a DNA sequencer (Applied Biosystems, 3130×1). Further, in order to prepare dominant negative Rac1, threonine at position 17 was mutated to asparagine using GeneTailor Site-Directed Mutagenesis System (Invitrogen). The mutated cDNA was confirmed with a DNA sequencer (Applied Biosystems, 3130×1).

On the other hand, pCAG (SEQ ID NO: 202) was treated with restriction enzymes SalI (TaKaRa) and NotI (TaKaRa); the intracellular fragment was cut out from the pBluescript obtained above with XhoI (TaKaRa) and NotI (TaKaRa) and the fragment was inserted into pCAG. It is possible to prepare pCAG based on publications such as Gene 108, 193-200, 1991, Japanese Patents Nos. 2824433 and 2824434, etc. The expression vectors for various intracellular fragments were constructed so that an Myc tag is added to the N-terminus of the integrated intracellular fragment.

(2) Transfer of Genes encoding EICD and EICD+Rac1N17 into NIH3T3 Cells and Analysis of Changes in Actin Cytoskeletons NIH3T3 cells were cultured in 10% CBS (flow)/Antibiotic-Antimycotic (Invitrogen)/DMEM (Invitrogen) under 5% CO$_2$ at 37° C. Genes encoding HA-EICD (SEQ ID NO: 93) or EICD+Rac1N17 (SEQ ID NO: 200) were transfected into the cells with Lipofectamine 2000 (Invitrogen). Eighteen hours later, the cells were replated in wells provided with poly-L-lysin (SIGMA)-coated 13 mm cover glass. Eighteen hours thereafter, the cells were fixed in 2% paraformaldehyde (Wako), treated with 0.25% TritonX-100 and blocked with BlockAce (Snow Brand Milk Products). After the blocking, the cells were treated with rat anti-HA antibody (Roche), followed by reaction with FITC-linked anti-rat IgG antibody (Jackson) and Alexa Fluor phalloidin 546 (Molecular probes). The thus prepared stained samples were observed with a confocal laser scanning microscope to quantitatively determine the formation of lamellipodia structures.

```
EICD + Rac1N17 DNA Sequence
                                      (SEQ ID NO: 200)
ATGGAGCAGAAGCTTATCAGCGAGGAGGACCTGGAATTCACGCGTGTCGA Catgcaggccatcaagtgtgtggtggtgggagacggagccgttggtaaaa actgcctgctcatcagttacacgaccaatgcgttccctggagagtacatc cccaccgtctttgacaactattctgccaatgttatggtagatggaaaacc agtgaatctgggcctctgggacacagctggacaggaagattatgacagac tgcgtccctctcctacccgcaaacagacgtgttcttaatttgcttttcc cttgtgagtcctgcatcatttgaaaatgtccgtgcaaagtggtatcctga agtacgacaccactgtcccaatactcccatcatcctagtggggacgaagc ttgatcttagggatgataaggacacgattgagaagctgaaggagaagaag ctgactcccattacctacccgcaggggctagccatggcgaaagagatcgg tgctgtcaaatacctggagtgctcagcactcacacagcgaggactcaaga cagtgtttgatgaagctatccgagccgttctctgtcccctcctgttaag aagaggaagagaaaatgcctgctgttgtaa
```

(Capital letters appearing at the 5' end of the nucleotide sequence represent a nucleotide sequence encoding Myc tag. Small letters appearing at the 3' end represent a nucleotide sequence encoding EphA4 intracellular fragment. Bold letters represent mutated nucleotides.)

```
EICD + Rac1N17 Amino Acid Sequence
                                      (SEQ ID NO: 201)
MEQKLISEEDLEFTRVDMQAIKCVVVGDGAVGKNCLLISYTTNAFPGEYI

PTVFDNYSANVMVDGKPVNLGLWDTAGQEDYDRLRPLSYPQTDVFLICFS

LVSPASFENVRAKWYPEVRHHCPNTPIILVGTKLDLRDDKDTIEKLKEKK

LTPITYPQGLAMAKEIGAVKYLECSALTQRGLKTVFDEAIRAVLCPPPVK

KRKRKCLLL
```

2. Experimental Results

Figure 6:
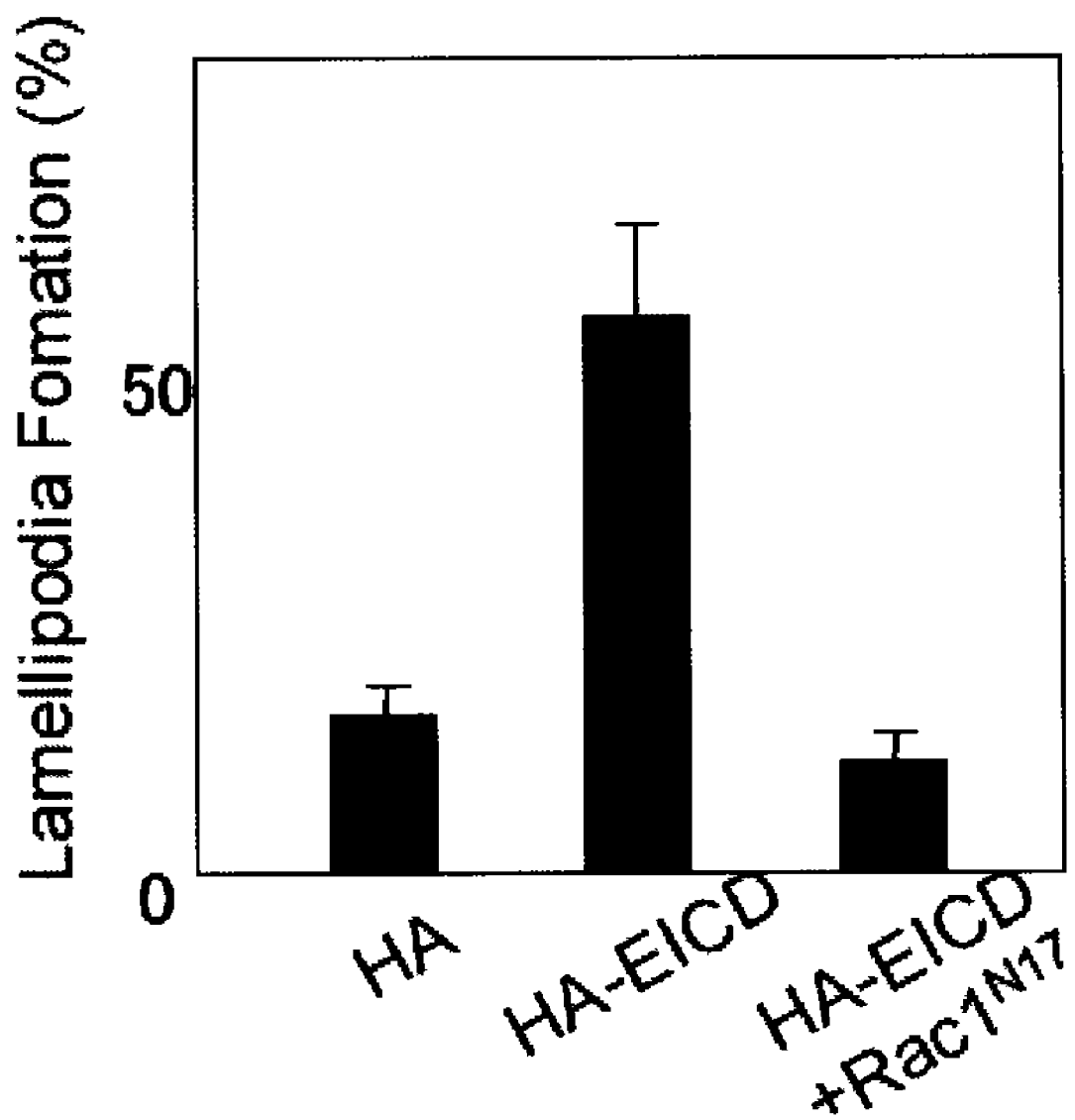
FIG. 6 shows the results of analysis of lamellipodia formation when various EphA4 intracellular fragments were expressed in NIH3T3 cells.

FIG. 6 shows the results.

In FIG. 6, "HA" indicates a NIH3T3 cell sample not transfected with EphA4 intracellular fragment. "HA-ECID" indicates a NIH3T3 cell sample transfected with EphA4 intracellular fragment. "HA-EICD+Rac1N17" indicates a NIH3T3 cell sample cotransfected with EphA4 intracellular fragment and Rac1N17 (a dominant negative form of Race).

When EphA4 intracellular fragment was transfected, lamellipodia formation is promoted (see FIG. 6). Thus, it was found that expression of EphA4 intracellular fragment in NIH3T3 cells induces and/or promotes lamellipodia formation.

On the other hand, when EphA4 intracellular fragment and Rac1N17 (a dominant negative form of Rac1) were cotransfected, this lamellipodia formation promotive capacity disappeared completely (see FIG. 6). Thus, it was revealed that EICD activates Rac1.

Example 7

Effect of γ-Secretase-Cleaved EphA4 Fragment on Rho Family-Mediated Signaling Pathway 1. Experimental Conditions and Experimental Methods In the above-mentioned Example 6, the EphA4 fragment used in Example 5 (SEQ ID NO: 197) was transfected instead of the HA-EphA4 intracellular fragment and lamellipodia formation was analyzed in the same way.

2. Experimental Results

Figure 7:
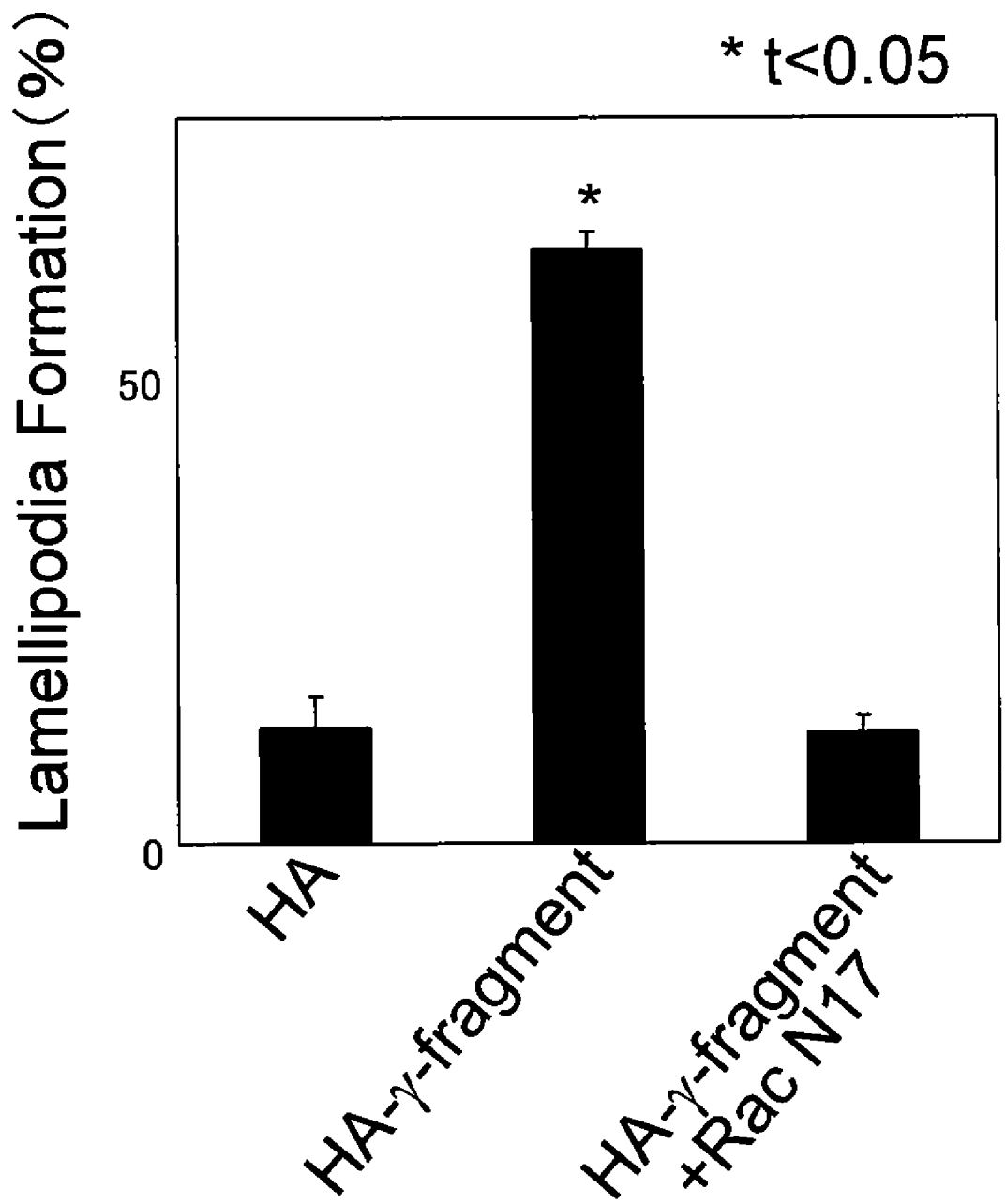
FIG. 7 shows the results of analysis of lamellipodia formation when γ-secretase-cleaved EphA4 fragments were expressed in NIH3T3 cells.

FIG. 7 shows the results.

In FIG. 7, "HA" indicates a NIH3T3 cell sample not transfected with γ-secretase-cleaved EphA4 fragment. "HA-γ-fragment" indicates a NIH3T3 cell sample transfected with γ-secretase-cleaved EphA4 fragment. "HA-γ-fragment+Rac1N17" indicates a NIH3T3 cell sample cotransfected with γ-secretase-cleaved EphA4 fragment and Rac1N17, a dominant negative form of Rac1.

Transfection with γ-secretase-cleaved EphA4 fragment promotes lamellipodia formation (see FIG. 7). Thus, it was found that expression of γ-secretase-cleaved EphA4 fragment in NIH3T3 cells induces and/or promotes lamellipodia formation.

On the other hand, when γ-secretase-cleaved EphA4 fragment and Rac1N17, a dominant negative form of Rac1, were cotransfected, this lamellipodia formation promotive capacity disappeared completely (see FIG. 7). Thus, it was revealed that EphA4 intracellular fragment activates Rac1 in the same manner as γ-secretase-cleaved EphA4 fragment.

Example 8

Determination of the Necessary Domain of EICD Involved in Rac1-Mediated Signaling Pathway Which domain of EICD produced by γ-secretase is necessary for the activation of Rac1 was analyzed.

1. Experimental Conditions and Experimental Methods (1) Construction of Expression Vector Using EphA4 cDNA as a template, regions corresponding to various intracellular domains of EphA4 (HA-EICD Δ1: 587 amino acid-Stop; HA-EICD Δ2: 622 amino acid-Stop; HA-EICD Δ3: 661 amino acid-Stop; and HA-EICD Δ4: 701 amino acid-Stop) were amplified separately with the following primers, the above-described primer2 and pfu (Stratagene):

```
Primer6 SalI site-added:
GAGGTCGACAAGCATTTGAATCAAGGTGTTAG,    (SEQ ID NO: 209)

Primer7 SalI site-added:
GAGGTCGACAAAATCGAAAAGGTCATTGGAG,    (SEQ ID NO: 210)

Primer8 SalI site-added:
GAGGTCGACGACAAGCAGAGGAGAGACTTCC,    (SEQ ID NO: 211)

Primer9 SalI site-added:
GAGGTCGACTACATGGAGAACGGCTCCTTGG     (SEQ ID NO: 212)
```

PCR conditions were as follows: first reaction at 95° C. for 2 minutes; then 25 cycles of (at 95° C. for 45 seconds→at 60° C. for 45 seconds→at 72° C. for 4 minutes); then final reaction at 72° C. for 7 minutes. The PCR product was purified with Quiaquick PCR purification kit (QIAGEN), treated with restriction enzymes SalI (TaKaRa) and NotI (TaKaRa) and then cloned into pBluescript (Stratagene). The DNA sequence after cloning was confirmed with a DNA sequencer (Applied Biosystems, 3130×1).

pCAG (SEQ ID NO: 202) was treated with restriction enzymes SalI (TaKaRa) and NotI (TaKaRa); the intracellular fragment was cut out from the pBluescript obtained above with XhoI (TaKaRa) and NotI (TaKaRa) and the fragment was inserted into pCAG. The expression vectors for various intracellular fragments were constructed so that an HA tag is added to the N-terminus of the integrated intracellular fragment.

(2) Transfer of Genes Encoding Various Intracellular Fragments into NIH3T3 Cells and Analysis of Changes in Actin Cytoskeletons Genes encoding HA, HA-EICD (SEQ ID NO: 93) and various EICD mutants (HA-EICD Δ1 to HA-EICD Δ4) prepared in (1) above were transfected to NIH3T3 cells separately in the same manner as described in Examples 6 and 7. Then, ratios of lamellipodia forming cells were examined. In the various EICD mutants described below, capital letters appearing at the 5' end of the nucleotide sequences represent a nucleotide sequence encoding HA tag. Small letters appearing at the 3' end represent a nucleotide sequence encoding EphA4 intracellular fragment.

```
HA-EICD Δ1 DNA Sequence
                                    (SEQ ID NO: 167)
ATGGACTACCCATACGACGTCCCAGACTACGCTACGCGT GTCGAC aagcatttgaatcaaggtgttagaacatacgtggatcccttacatatga agacccaaccaggcagttcgagaatttgccaaagaaatcgatgcctcct gcattaaaatcgaaaaggtcattggagttggcgaatttggagaagtctgc agtgggcgtctcaaagtgcccggcaagagagagatctgtgtggccatcaa gactctgaaagctggttatactgacaagcagaggagagacttcctgagcg aggccagcatcatgggacagtttgaccacccaaacataatccacctggaa ggcgttgtcaccaaatgtaaaccagtaatgatcatcacggagtacatgga gaacggctccttggacgctttcctcaggaagaatgatggccgatttacag tcattcagctggtgggcatgctccgaggcattggctcggggatgaagtat ttatctgatatgagctatgtgcatcgagacctggctgccaggaacattct ggtaaatagcaacttggtctgcaaggtgtctgatttcggcatgtccaggg tgcttgaggatgacccggaagcagcctatactaccaggggcggcaagatt cccatccggtggactgcaccagaagcaattgcgtatcgtaaatttacctc agccagtgacgtctggagctacggaatcgttatgtgggaagtgatgtcat atggagagaggccgtactgggatatgtccaatcaagatgtgatcaaagcc atcgaggaagggtaccggctacccccgccaatggactgccccattgccct ccatcagttaatgctggactgttggcagaaagagagaagcgacaggccta aatttgggcagatcgtcaacatgttggacaaactcatccgcaaccccaac agcctgaagaggacagggccagagagttccagaccaaacacagccttgtt
```

-continued agatcccagctcccctgaattctccgccgtagtatcagtgggtgactggc
tgcaggccatcaaaatggaccggtataaggacaacttcacagccgccggg
tacacgacactagaagctgtggttcacatgagccaggatgacctggcgcg
aattggcatcaccgcaatcacgcaccagaataagattttgagcagcgtcc
aggcgatgcgaacccagatgcagcagatgcatggcaggatggttcctgtc
tga HA-EICD Δ1 Amino Acid Sequence
(SEQ ID NO: 168)
MDYPYDVPDYATRVDKHLNQGVRTYVDPFTYEDPNQAVREFAKEIDASCI
KIEKVIGVGEFGEVCSGRLKVPGKREICVAIKTLKAGYTDKQRRDFLSEA
SIMGQFDHPNIIHLEGVVTKCKPVMIITEYMENGSLDAFLRKNDGRFTVI
QLVGMLRGIGSGMKYLSDMSYVHRDLAARNILVNSNLVCKVSDFGMSRVL
EDDPEAAYTTRGGKIPIRWTAPEAIAYRKFTSASDVWSYGIVMWEVMSYG
ERPYWDMSNQDVIKAIEEGYRLPPPMDCPIALHQLMLDCWQKERSDRPKF
GQIVNMLDKLIRNPNSLKRTGPESSRPNTALLDPSSPEFSAVVSVGDWLQ
AIKMDRYKDNFTAAGYTTLEAVVHMSQDDLARIGITAITHQNKILSSVQA
MRTQMQQMHGRMVPV HA-EICD Δ2 DNA Sequence
(SEQ ID NO: 169)
ATGGACTACCCATACGACGTCCCAGACTACGCTACGCGT GTCGAC
aaaatcgaaaaggtcattggagttggcgaatttggagaagtctgcagtgg
gcgtctcaaagtgcccggcaagagagagatctgtgtggccatcaagactc
tgaaagctggttatactgacaagcagaggagagacttcctgagcgaggcc
agcatcatgggacagtttgaccacccaaacataatccacctggaaggcgt
tgtcaccaaatgtaaaccagtaatgatcatcacggagtacatggagaacg
gctccttggacgctttcctcaggaagaatgatggccgatttacagtcatt
cagctggtgggcatgctccgaggcattggctcggggatgaagtatttatc
tgatatgagctatgtgcatcgagacctggctgccaggaacattctggtaa
atagcaacttggtctgcaaggtgtctgatttcggcatgtccagggtgctt
gaggatgacccggaagcagcctatactaccaggggcggcaagattcccat
ccggtggactgcaccagaagcaattgcgtatcgtaaatttacctcagcca
gtgacgtctggagctacggaatcgttatgtgggaagtgatgtcatatgga
gagaggccgtactgggatatgtccaatcaagatgtgatcaaagccatcga
ggaagggtaccggctaccccgccaatggactgcccattgccctccatc
agttaatgctggactgttggcagaaagagagaagcgacaggcctaaattt
gggcagatcgtcaacatgttggacaaactcatccgcaaccccaacagcct
gaagaggacagggccagagagttccagaccaaacacagccttgttagatc
ccagctcccctgaattctccgccgtagtatcagtgggtgactggctgcag
gccatcaaaatggaccggtataaggacaacttcacagccgccgggtacac
gacactagaagctgtggttcacatgagccaggatgacctggcgcgaattg
gcatcaccgcaatcacgcaccagaataagattttgagcagcgtccaggcg
atgcgaacccagatgcagcagatgcatggcaggatggttcctgtctga HA-EICD Δ2 Amino Acid Sequence
(SEQ ID NO: 170)
MDYPYDVPDYATRVDKIEKVIGVGEFGEVCSGRLKVPGKREICVAIKTLK
AGYTDKQRRDFLSEASIMGQFDHPNIIHLEGVVTKCKPVMIITEYMENGS
LDAFLRKNDGRFTVIQLVGMLRGIGSGMKYLSDMSYVHRDLAARNILVNS
NLVCKVSDFGMSRVLEDDPEAAYTTRGGKIPIRWTAPEAIAYRKFTSASD
VWSYGIVMWEVMSYGERPYWDMSNQDVIKAIEEGYRLPPPMDCPIALHQL
MLDCWQKERSDRPKFGQIVNMLDKLIRNPNSLKRTGPESSRPNTALLDPS
SPEFSAVVSVGDWLQAIKMDRYKDNFTAAGYTTLEAVVHMSQDDLARIGI
TAITHQNKILSSVQAMRTQMQQMHGRMVPV HA-EICD Δ3 DNA Sequence
(SEQ ID NO: 171)
ATGGACTACCCATACGACGTCCCAGACTACGCTACGCGT GTCGAC
gacaagcagaggagagacttcctgagcgaggccagcatcatgggacagtt
tgaccacccaaacataatccacctggaaggcgttgtcaccaaatgtaaac
cagtaatgatcatcacggagtacatggagaacggctccttggacgctttc
ctcaggaagaatgatggccgatttacagtcattcagctggtgggcatgct
ccgaggcattggctcggggatgaagtatttatctgatatgagctatgtgc
atcgagacctggctgccaggaacattctggtaaatagcaacttggtctgc
aaggtgtctgatttcggcatgtccagggtgcttgaggatgacccggaagc
agcctatactaccaggggcggcaagattcccatccggtggactgcaccag
aagcaattgcgtatcgtaaatttacctcagccagtgacgtctggagctac
ggaatcgttatgtgggaagtgatgtcatatggagagaggccgtactggga
tatgtccaatcaagatgtgatcaaagccatcgaggaagggtaccggctac
cccgccaatggactgcccattgccctccatcagttaatgctggactgt
tggcagaaagagagaagcgacaggcctaaatttgggcagatcgtcaacat
gttggacaaactcatccgcaaccccaacagcctgaagaggacagggccag
agagttccagaccaaacacagccttgttagatcccagctcccctgaattc
tccgccgtagtatcagtgggtgactggctgcaggccatcaaaatggaccg
gtataaggacaacttcacagccgccgggtacacgacactagaagctgtgg
ttcacatgagccaggatgacctggcgcgaattggcatcaccgcaatcacg
caccagaataagattttgagcagcgtccaggcgatgcgaacccagatgca
gcagatgcatggcaggatggttcctgtctga HA-EICD Δ3 Amino Acid Sequence
(SEQ ID NO: 172)
MDYPYDVPDYATRVDDKQRRDFLSEASIMGQFDHPNIIHLEGVVTKCKPV
MIITEYMENGSLDAFLRKNDGRFTVIQLVGMLRGIGSGMKYLSDMSYVHR
DLAARNILVNSNLVCKVSDFGMSRVLEDDPEAAYTTRGGKIPIRWTAPEA
IAYRKFTSASDVWSYGIVMWEVMSYGERPYWDMSNQDVIKAIEEGYRLPP
PMDCPIALHQLMLDCWQKERSDRPKFGQIVNMLDKLIRNPNSLKRTGPES
SRPNTALLDPSSPEFSAVVSVGDWLQAIKMDRYKDNFTAAGYTTLEAVVH
MSQDDLARIGITAITHQNKILSSVQAMRTQMQQMHGRMVPV HA-EICD Δ4 DNA Sequence -continued (SEQ ID NO: 173)
ATGGACTACCCATACGACGTCCCAGACTACGCTACGCGT GTCGAC tacatggagaacggctccttggacgctttcctcaggaagaatgatggccg atttacagtcattcagctggtgggcatgctccgaggcattggctcgggga tgaagtatttatctgatatgagctatgtgcatcgagacctggctgccagg aacattctggtaaatagcaacttggtctgcaaggtgtctgatttcggcat gtccagggtgcttgaggatgacccggaagcagcctatactaccaggggcg gcaagattcccatccggtggactgcaccagaagcaattgcgtatcgtaaa tttacctcagccagtgacgtctggagctacggaatcgttatgtgggaagt gatgtcatatggagagaggccgtactgggatatgtccaatcaagatgtga tcaaagccatcgaggaagggtaccggctaccccgccaatggactgcccc attgccctccatcagttaatgctggactgttggcagaaagagagaagcga caggcctaaatttgggcagatcgtcaacatgttggacaaactcatccgca accccaacagcctgaagaggacagggccagagagttccagaccaaacaca gccttgttagatcccagctcccctgaattctccgccgtagtatcagtggg tgactggctgcaggccatcaaaatggaccggtataaggacaacttcacag ccgccgggtacacgacactagaagctgtggttcacatgagccaggatgac ctggcgcgaattggcatcaccgcaatcacgcaccagaataagatttgag cagcgtccaggcgatgcgaacccagatgcagcagatgcatggcaggatgg ttcctgtctga HA-EICD Δ4 Amino Acid Sequence
(SEQ ID NO: 174)
MDYPYDVPDYATRVDYMENGSLDAFLRKNDGRFTVIQLVGMLRGIGSGMK

YLSDMSYVHRDLAARNILVNSNLVCKVSDFGMSRVLEDDPEAAYTTRGGK

IPIRWTAPEAIAYRKFTSASDVWSYGIVMWEVMSYGERPYWDMSNQDVIK

AIEEGYRLPPPMDCPIALHQLMLDCWQKERSDRPKFGQIVNMLDKLIRNP

NSLKRTGPESSRPNTALLDPSSPEFSAVVSVGDWLQAIKMDRYKDNFTAA

GYTTLEAVVHMSQDDLARIGITAITHQNKILSSVQAMRTQMQQMHGRMVP

V

EICD Δ1 DNA Sequence
(SEQ ID NO: 195)
aagcatttgaatcaaggtgttagaacatacgtggatcccttttacatatga agacccaaccaggcagttcgagaatttgccaaagaaatcgatgcctcct gcattaaaatcgaaaaggtcattggagttggcgaatttggagaagtctgc agtgggcgtctcaaagtgcccggcaagagagagatctgtgtggccatcaa gactctgaaagctggttatactgacaagcagaggagagacttcctgagcg aggccagcatcatgggacagtttgaccacccaaacataatccacctggaa ggcgttgtcaccaaatgtaaaccagtaatgatcatcacggagtacatgga gaacggctccttggacgctttcctcaggaagaatgatggccgatttacag tcattcagctggtgggcatgctccgaggcattggctcggggatgaagtat ttatctgatatgagctatgtgcatcgagacctggctgccaggaacattct ggtaaatagcaacttggtctgcaaggtgtctgatttcggcatgtccaggg tgcttgaggatgacccggaagcagcctatactaccaggggcggcaagatt cccatccggtggactgcaccagaagcaattgcgtatcgtaaatttacctc agccagtgacgtctggagctacggaatcgttatgtgggaagtgatgtcat atggagagaggccgtactgggatatgtccaatcaagatgtgatcaaagcc atcgaggaagggtaccggctaccccgccaatggactgccccattgccct ccatcagttaatgctggactgttggcagaaagagagaagcgacaggccta aatttgggcagatcgtcaacatgttggacaaactcatccgcaaccccaac agcctgaagaggacagggccagagagttccagaccaaacacagccttgtt agatcccagctcccctgaattctccgccgtagtatcagtgggtgactggc tgcaggccatcaaaatggaccggtataaggacaacttcacagccgccggg tacacgacactagaagctgtggttcacatgagccaggatgacctggcgcg aattggcatcaccgcaatcacgcaccagaataagatttgagcagcgtcc aggcgatgcgaacccagatgcagcagatgcatggcaggatggttcctgtc tga EICDΔ1 Amino Acid Sequence
(SEQ ID NO: 196)
KHLNQGVRTYVDPFTYEDPNQAVREFAKEIDASCIKIEKVIGVGEFGEVC

SGRLKVPGKREICVAIKTLKAGYTDKQRRDFLSEASIMGQFDHPNIIHLE

GVVTKCKPVMIITEYMENGSLDAFLRKNDGRFTVIQLVGMLRGIGSGMKY

LSDMSYVHRDLAARNILVNSNLVCKVSDFGMSRVLEDDPEAAYTTRGGKI

PIRWTAPEAIAYRKFTSASDVWSYGIVMWEVMSYGERPYWDMSNQDVIKA

IEEGYRLPPPMDCPIALHQLMLDCWQKERSDRPKFGQIVNMLDKLIRNPN

SLKRTGPESSRPNTALLDPSSPEFSAVVSVGDWLQAIKMDRYKDNFTAAG

YTTLEAVVHMSQDDLARIGITAITHQNKILSSVQAMRTQMQQMHGRMVPV

2. Experimental Results

Figure 8:
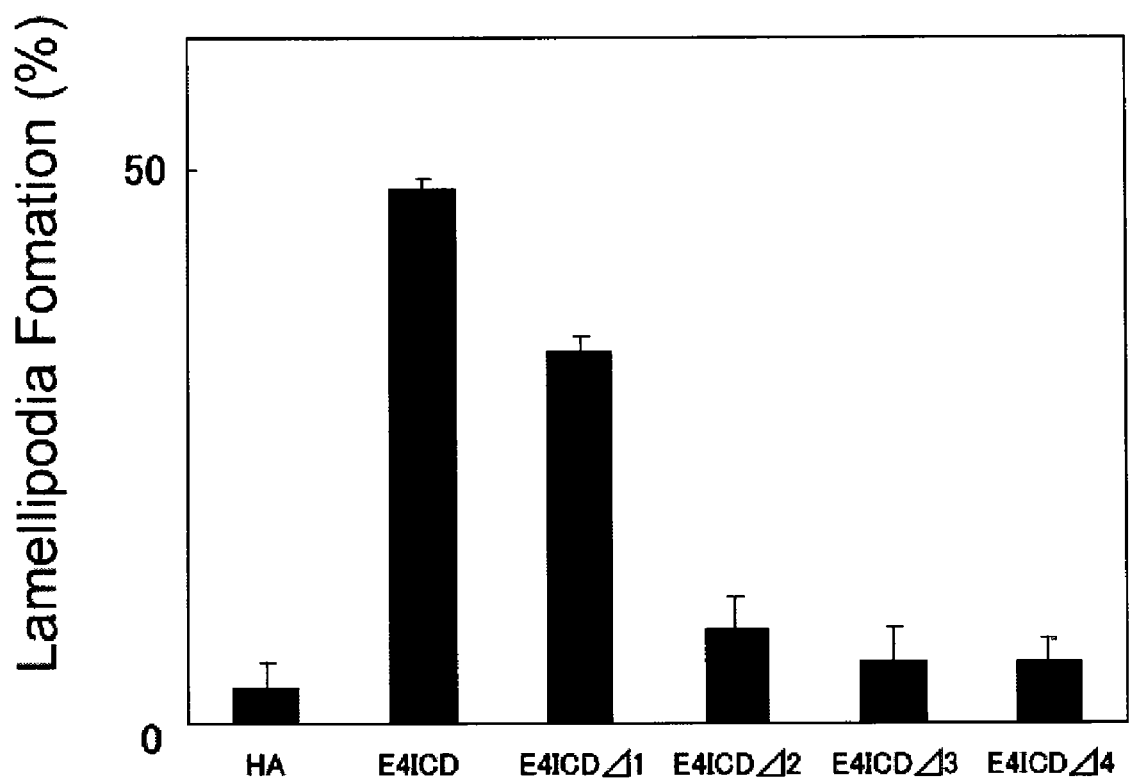
FIG. 8 shows the results of analysis of the Rac1 activating domain in EphA4 intracellular fragments.

FIG. 8 shows the results. In this Figure, HA, E4ICD, E4ICD Δ1, E4ICD Δ2, E4ICD Δ3 and E4ICD Δ4 represent cells transfected with HA, HA-EICD, HA-EICD Δ1, HA-EICD Δ2, HA-EIC Δ3 and HA-EICD Δ4, respectively.

While lamellipodia forming cells are increased in EICD Δ1, ratios of lamellipodia forming cells in EICD Δ2, EICD Δ3 and EICD Δ4 are almost the same level as that of HA (see FIG. 8).

Accordingly, since HA-EICD Δ2, Δ3 and Δ4 have no lamellipodia formation capacity, it was found that a domain up to HA-EICD Δ1 (587 amino acid-Stop) on the N-terminal side out of those fragments cleaved by γ-secretase is at least necessary. Briefly, it was revealed that, in the sequence as shown in SEQ ID NO: 2, the domain necessary for Rac1 activation is a sequence whose N-terminus starts between positions 564 and 621, preferably 564 and 587. Since the sequence of HA-EICD Δ2 is lacking regions corresponding to autophosphorylation domain, it was also revealed that at least these two domains must be conserved in a cleaved fragment, for the activation of Rac1.

The technical terms used herein are used only for the purpose of illustrating a specific embodiment and not intended to limit the embodiment.

Unless otherwise specifically defined, all technical terms and scientific terms used herein have the same meaning as generally understood by those skilled in the art. Although any methods and materials similar to or equivalent to those described herein may be used in the practice or test of the present invention, those skilled in the art can consult the description provided herein, for preferable methods and materials.

All publications cited herein are incorporated herein by reference in their entirety for the purpose of describing and disclosing, for example, the cell systems, constructs and methods described in the publications that are used in connection with the present invention, or incorporated herein as references with respect to the disclosure of the compound identification method, screening method and methodologies therefor, and composition of the present invention; such publications may be used for the practice of the present invention.

INDUSTRIAL APPLICABILITY

According to the present invention, EphA4 polypeptide with a novel activity and use thereof are provided. The present invention provides intracellular EphA4 polypeptides processed by γ-secretase and antibodies specific to them, and is capable of selecting those compounds which selectively act on the cleavage of EphA4 and spine formation by γ-secretase, spine formation and Rac activation by γ-secretase-processed EphA4 intracellular fragment or the degradation of γ-secretase-processed EphA4 intracellular fragment. With such compounds selected by the present invention, it becomes possible to develop therapeutics for memory disorder of interest, especially dementia (preferably AD).

Sequence Listing Free Text

SEQ ID NO: 199: synthetic DNA

SEQ ID NOS: 202 to 212: synthetic DNAs

SEQUENCE LISTING (211 sequences)

SEQ ID NO: 1 - DNA, 2961 bp, Rattus norvegicus
  CDS (1)..(2958)
atggctgggattttctatttcatcctcttttcgtttctctttggaatttgcgacgctgtcaccggttctagggtatacccggcgaatgaagttactttattggattccagatctgttcagggagagcttgggtggatagcaagccctctggaaggagggtgggaggaagtaagcattatggatgagaaaaatacaccgatccgaacctaccaggtatgcaacgtgatggaagccagtcagaacaactggctgcgaactgactggatcacccgagaaggggcgcagagggtgtacattgaaattaagttcactctgagggactgcaacagtcttccgggcgtcatggggacttgcaaggagacgtttaacctttactactatgaatcggacaacgacaaggagcgcttcatcagagagagccagttcggcaagatcgacaccatcgcagcggatgagagctttacacaggtggacattggggacagaatcatgaagctcaacaccgagatccgggatgtagggcccctgagcaagaagggtttttacctggcttttcaggatgtgggtgcttgcatcgccctggtgtctgttcgtgtgttctacaagaagtgtcccctcaccgttcgaaatctagcccagttccccgataccatcactggggctgatacctcttccctggtggaagttcgaggctcctgtgtcaacaactcagaagagaaggatgtgccaaaaatgtactgtggggcagatggtgaatggctggtacccattggcaactgcctatgcaatgctgggcacgaggagcagaatggtgaatgccaagcttgcaaaattggatattacaaagctctctccacggacgccacctgtgccaagtgtccaccgcacagctactctgtctgggaaggagccacgtcctgcacctgtgaccgaggctttttcagagctgacaacgatgccgcgtccatgccctgcacccgcccaccatctgctcccctcaacttgatttctaatgtcaacgagacgtcggtgaacttggaatggagcagtcctcagaacacaggtggccgtcaggacatttcttacaacgtggtctgcaagaaatgtggagctggggatcccagcaagtgtcgaccctgtggaagtggagtccactacacgccacagcagaatggactcaagacgaccagagtctccatcactgacctcctagcacacaccaattacacgtttgagatctgggcagtgaatggcgtgtctaagtacaaccctagcccagaccagtcagtgtctgtcacagtgacaaccaaccaagcagcaccatcatccattgctttggtccaggctaaagaagttacaagatacagtgtggctctggcttggctggaaccagatcgaccaaacggagtcatcttagaatatgaagtgaaatattatgaaaaggatcagaatgaacgaagctatcgcatagttcggacagctgccaggaacacagatatcaaaggcctgaaccctttgacttcttacgtcttccacgtgcgagccaggaccgccgctggctatggagacttcagcgaacccttggaagtcactaccaatacagtgccttcccgaatcattggcgacggggccaactctaccgtcctgctggtctccgtctctggcagtgtagtactcgtggtcattctcattgcggcatttgtgatcagccgtagacggagtaagtacagccaagcaaagcaagaagcagatgaagagaagcatttgaatcaaggtgttagaacatacgtggatccctttacatatgaagaccccaaccaggcagttcgagaatttgccaaagaaatcgatgcctcctgcattaaaatcgaaaaggtcattggagttggcgaatttggagaagtctgcagtgggcgtctcaaagtgcccggcaagagagagatctgtgtggccatcaagactctgaaagctggttatactgacaagcagaggagagacttcctgagcgaggccagcatcatgggacagtttgaccacccaaacataatccacctggaaggcgttgtcaccaaatgtaaaccagtaatgatcatcacggagtacatggagaacggctccttggacgctttcctcaggaagaatgatggccgatttacagtcattcagctggtgggcatgctccgaggcattggctcggggatgaagtacttatctgatatgagctatgtgcatcgagacctggctgccaggaacattctggtaaacagcaacttggtctgcaaggtgtctgatttcggcatgtccagggtgcttgaggatgacccggaagcagcctatactaccaggggcggcaagattcccatccggtggactgcaccagaagcaattgcgtatcgtaaatttacctcagccagtgacgtctggagctacggaatcgttatgtgggaagtgatgtcatatggagagaggccgtactgggatatgtccaatcaagatgtgatcaaagccatcgaggaagggtaccggctacccccgccaatggactgccccattgccctccatcagttaatgctggactgttggcagaaagagagaagcgacaggcctaaatttgggcagatcgtcaacatgttggacaaactcatccgcaaccccaacagcctgaagaggacagggccagagagttccagaccaaacacagccttgttagatcccagctcccctgaattctccgccgtagtatcagtgggtgactggctgcaggccatcaaaatggaccggtataaggacaacttcacagccgccgggtacacgacactagaagctgtggttcacatgagccaggatgacctggcgcgaattggcatcaccgcaatcacgcaccagaataagattttgagcagcgtccaggcgatgcgaacccagatgcagcagatgcatggcaggatggttcctgtctga

SEQ ID NO: 2 - protein, 986 aa, Rattus norvegicus
MAGIFYFILFSFLFGICDAVTGSRVYPANEVTLLDSRSVQGELGWIASPLEGGWEEVSIMDEKNTPIRTYQVCNVMEASQNNWLRTDWITREGAQRVYIEIKFTLRDCNSLPGVMGTCKETFNLYYYESDNDKERFIRESQFGKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSQAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGPESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 3 - DNA, 3000 bp, Rattus norvegicus
  CDS (1)..(2997)
atggctgggattttctatttcatcctcttttcgtttctctttggaatttgcgacgctgtcaccggttctagggtatacccggcgaatgaagttactttattggattccagatctgttcagggagagcttgggtggatagcaagccctctggaaggagggtgggaggaagtaagcattatggatgagaaaaatacaccgatccgaacctaccaggtatgcaacgtgatggaagccagtcagaacaactggctgcgaactgactggatcacccgagaaggggcgcagagggtgtacattgaaattaagttcactctgagggactgcaacagtcttccgggcgtcatggggacttgcaaggagacgtttaacctttactactatgaatcggacaacgacaaggagcgcttcatcagagagagccagttcggcaagatcgacaccatcgcagcggatgagagctttacacaggtggacattggggacagaatcatgaagctcaacaccgagatccgggatgtagggcccctgagcaagaagggtttttacctggcttttcaggatgtgggtgcttgcatcgccctggtgtctgttcgtgtgttctacaagaagtgtcccctcaccgttcgaaatctagcccagttccccgataccatcactggggctgatacctcttccctggtggaagttcgaggctcctgtgtcaacaactcagaagagaaggatgtgccaaaaatgtactgtggggcagatggtgaatggctggtacccattggcaactgcctatgcaatgctgggcacgaggagcagaatggtgaatgccaagcttgcaaaattggatattacaaagctctctccacggatgccacctgtgccaagtgtccaccgcacagctactctgtctgggaaggagccacgtcctgcacctgtgaccgaggctttttcagagctgacaacgatgccgcgtccatgccctgcacccgcccaccatctgctcccctcaacttgatttctaatgtcaacgagacgtcggtgaacttggaatggagcagtcctcagaacacaggtggccgtcaggacatttcttacaacgtggtctgcaagaaatgtggtgctggggatcccagcaagtgtcgaccctgtggaagtggagtccactacacgccacagcagaatggactcaagacgaccagagtctccatcactgacctcctagcacacaccaattacacgtttgagatctgggcagtgaatggcgtgtctaagtacaaccctagcccggaccagtcagtgtctgtcacagtgacaaccaaccaagcagcgccatcatccattgctttggtccaggctaaagaagttacaagatacagtgtggctctggcttggctggaaccagatcgaccaaacggagtcatcttagaatatgaagtgaaatattatgaaaaggatcagaatgaacgaagctatcgcatagttcggacagctgccaggaacacagatatcaaaggcctgaaccctttgacttcttacgtcttccacgtgcgagccaggaccgccgctggctatggagacttcagcgaacccttggaagtcactaccaatacagtgccttcccgaatcattggtgatggggccaactctaccgtcctgctggtctccgtctctggcagtgtagtactcgtggtcattctcattgcggcatttgtgatcagccgtagacggagtaagtacagccaagcaaagcaagaagcagatgaagagaagcatttgaatcaaggtgttagaacatacgtggatccctttacatatgaagaccccaaccaggcagttcgagaatttgccaaagaaatcgatgcctcctgcattaaaatcgaaaaggtcattggagttggcgaatttggagaagtctgcagtgggcgtctcaaagtgcccggcaagagagagatctgtgtggccatcaagactctgaaagctggttatactgacaagcagaggagagacttcctgagcgaggccagcatcatgggacagtttgaccacccaaacataatccacctggaaggcgttgtcaccaaatgtaaaccagtaatgatcatcacggagtacatggagaacggctccttggacgctttcctcaggaagaatgatggccgatttacagtcattcagctggtgggcatgctccgaggcattggctcggggatgaagtatttatctgatatgagctatgtgcatcgagacctggctgccaggaacattctggtaaatagcaacttggtctgcaaggtgtctgatttcggcatgtccagggtgcttgaggatgacccggaagcagcctatactaccaggggcggcaagattcccatccggtggactgcaccagaagcaattgcgtatcgtaaatttacctcagccagtgacgtctggagctacggaatcgttatgtgggaagtgatgtcatatggagagaggccgtactgggatatgtccaatcaagatgtgatcaaagccatcgaggaagggtaccggctacccccgccaatggactgccccattgccctccatcagttaatgctggactgttggcagaaagagagaagcgacaggcctaaatttgggcagatcgtcaacatgttggacaaactcatccgcaaccccaacagcctgaagaggacagggccagagagttccagaccaaacacagccttgttagatcccagctcccctgaattctccgccgtagtatcagtgggtgactggctgcaggccatcaaaatggaccggtataaggacaacttcacagccgccgggtacacgacactagaagctgtggttcacatgagccaggatgacctggcgcgaattggcatcaccgcaatcacgcaccagaataagattttgagcagcgtccaggcgatgcgaacccagatgcagcagatgcatggcaggatggttcctgtcgcggccgcagactacccatacgacgtcccagactacgcttag

SEQ ID NO: 4 - protein, 999 aa, Rattus norvegicus
MAGIFYFILFSFLFGICDAVTGSRVYPANEVTLLDSRSVQGELGWIASPLEGGWEEVSIMDEKNTPIRTYQVCNVMEASQNNWLRTDWITREGAQRVYIEIKFTLRDCNSLPGVMGTCKETFNLYYYESDNDKERFIRESQFGKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSQAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGPESSRPNTALLDPSSPEFSAVVSVGDWLQAIKMDRYKDNFTAAGYTTLEAVVHMSQDDLARIGITAITHQNKILSSVQAMRTQMQQMHGRMVPVAAADYPYDVPDYA

SEQ ID NO: 5 - DNA, 2961 bp, Homo sapiens
  CDS (1)..(2958)
atggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 6 - protein, 986 aa, Homo sapiens
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 7 - DNA, 2850 bp, Homo sapiens
  CDS (1)..(2847)
atggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccatgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggtcattaaaatggaccggtataaggataacttcacagctgctggttataccacactagaggctgtggtgcacgtgaaccaggagtaa

SEQ ID NO: 8 - protein, 949 aa, Homo sapiens [sequence omitted]

SEQ ID NO: 9 - DNA, 2961 bp, Mus musculus
  CDS (1)..(2958)
atggctgggattttctatttcatcctcttttcgtttctctttggaatttgcgacgctgtcaccggttctagggtataccccgcgaatgaagttactttattggattccagatctgttcagggagagcttgggtggatagcaagccctctggaaggagggtgggaggaagtgagcattatggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactactatgagtcggacaacgacaaggagcgcttcatcagagagagccagtttggcaagatcgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgataccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggacgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaacgagacatcggtgaacttggaatggagcagccctcagaacacaggtggccgtcaggacatttcttacaacgtggtctgcaagaaatgtggagctggtgatcccagcaagtgccggccctgtggaagtggagtccactacacaccacagcagaacggactcaagacgaccagagtctccatcactgacctcctagcacacaccaattacacgtttgagatctgggcagtgaatggagtgtctaagtataaccctagcccggaccagtccgtgtctgtcacagtgacaaccaaccaagcagcaccatcatccattgctttggtccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctctgacttcctatgtttttcacgtgcgagccaggaccgctgctggctacggagacttcagcgagcccctggaagtcactactaatacagtgccttcccgcatcattggcgatggagccaactccactgtcctgctggtctccgtctctggcagtgtggtcctcgtggtcattctcattgcagcttttgtgatcagccgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaattgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagtgacaggcctaaatttgggcagatcgtcaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctga

SEQ ID NO: 10 - protein, 986 aa, Mus musculus
MAGIFYFILFSFLFGICDAVTGSRVYPANEVTLLDSRSVQGELGWIASPLEGGWEEVSIMDEKNTPIRTYQVCNVMEASQNNWLRTDWITREGAQRVYIEIKFTLRDCNSLPGVMGTCKETFNLYYYESDNDKERFIRESQFGKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDASCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 11 - DNA, 2961 bp, Mus musculus
  CDS (1)..(2958)
atggctgggattttctatttcatcctcttttcgtttctctttggaatttgcgacgctgtcaccggttctagggtataccccgcgaatgaagttactttattggattccagatctgttcagggagagcttgggtggatagcaagccctctggaaggagggtgggaggaagtgagcattatggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactactatgagtcggacaacgacaaggagcgcttcatcagagagagccagtttggcaagatcgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgataccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggacgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaatgagacatcggtgaacttggaatggagcagccctcagaacacaggtggccgtcaggacatttcttacaacgtggtctgcaagaaatgtggagctggtgatcccagcaagtgccggccctgtggaagtggagtccactacacaccacagcagaacggactcaagacgaccagagtctccatcactgacctcctagcacacaccaattacacgtttgagatctgggcagtgaatggagtgtctaagtataaccctagcccggaccagtccgtgtctgtcacagtgacaaccaaccaagcagcaccatcatccattgctttggtccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctctgacttcctatgtttttcacgtgcgagccaggaccgctgctggctacggagacttcagcgagcccctggaagtcactactaatacagtgccttcccgcatcattggcgatggagccaactccactgtcctgctggtctccgtctctggcagtgtggtcctcgtggtcattctcattgcagcttttgtgatcagccgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaattgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagtgacaggcctaaatttgggcagatcgtcaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctga

SEQ ID NO: 12 - protein, 986 aa, Mus musculus; identical to SEQ ID NO: 10

SEQ ID NO: 13 - DNA, 2961 bp, Mus musculus
  CDS (1)..(2958)
atggctgggattttctatttcatcctcttttcgtttctctttggaatttgcgacgctgtcaccggttctagggtataccccgcgaatgaagttactttattggattccagatctgttcagggagagcttgggtggatagcaagccctctggaaggagggtgggaggaagtgagcattatggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactactatgagtcggacaacgacaaggagcgcttcatcagagagagccagtttggcaagactgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgacaccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggacgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaacgagacatcggtgaacttggaatggagcagccctcagaacacaggtggccgtcaggacatttcttacaacgtggtctgcaagaaatgtggagctggtgatcccagcaagtgccggccctgtggaagtggagtccactacacaccacagcagaacggactcaagacgaccagagtctccatcactgacctcctagcacacaccaattacacgtttgagatctgggcagtgaatggagtgtctaagtataaccctagcccggaccagtccgtgtctgtcacagtgacaaccaaccaagcagcaccatcatccattgctttggtccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctctgacttcctatgtttttcacgtgcgagccaggaccgctgctggctacggagacttcagcgagcccctggaagtcactactaatacagtgccttcccgcatcattggcgatggagccaactccactgtcctgctggtctccgtctctggcagtgtggtcctcgtggtcattctcattgcagcttttgtgatcagccgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaattgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagtgacaggcctaaatttgggcagatcgtcaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctga

SEQ ID NO: 14 - protein, 986 aa, Mus musculus
MAGIFYFILFSFLFGICDAVTGSRVYPANEVTLLDSRSVQGELGWIASPLEGGWEEVSIMDEKNTPIRTYQVCNVMEASQNNWLRTDWITREGAQRVYIEIKFTLRDCNSLPGVMGTCKETFNLYYYESDNDKERFIRESQFGKTDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDASCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 15 - DNA, 2784 bp, Mus musculus
  CDS (1)..(2781)
atggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactattatgagtcggacaacgacaaggagcgcttcatcagagagagccagtttggcaagatcgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgataccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggatgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaacgagacatcggtgaacttggaatggagcagtcctcagaacacaggtggccgtcaggacatttcttacaacgtggtctgcaagaaatgtggagctggtgatcccagcaaatgccggccctgtggaagtggagtccactacacaccacagcagaacggactcaagacgaccagagtctccatcactgacctcctagcacacaccaattacacgtttgagatctgggcagtgaatgaagtgtctaagtataaccctagcccggaccagtccgtgtctgtcacagtgacaaccaaccaagcagcaccatcatccattgctttggtccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctcttacttcctatgttttccacgtgcgagccaggaccgctgctggctacggagacttcagcgagcccctggaagtcactactaatacagtgccttcccgcatcattggcgatggagccaactccactgtcctgctggtctctgtctctggcagtgtggtcctcgtggtcattctcattgcagcttttgtgatcagccgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaatcgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagcgacaggcctaaatttgggcagatcgttaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctga

SEQ ID NO: 16 - protein, 927 aa, Mus musculus
MDEKNTPIRTYQVCNVMEASQNNWLRTDWITREGAQRVYIEIKFTLRDCNSLPGVMGTCKETFNLYYYESDNDKERFIRESQFGKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDASCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNEVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 17 - DNA, 1725 bp, Mus musculus
  CDS (1)..(1722)
cgaaccatggctgggattttctatttcatcctcttttcgtttctctttggaatttgcgacgctgtcaccggttctagggtataccccgcgaatgaagttactttattggattccagatctgttcagggagagcttgggtggatagcaagccctctggaaggagggtgggaggaagtgagcattatggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactactatgagtcggacaacgacaaggagcgcttcatcagagagagccagtttggcaagatcgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgataccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggacgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaacgagacatcggtgaacttggaatggagcagccctcagaacacaggtggccgtcaggacatttcttacaacgtggtctgcaagaaatgtggagctggtgatcccagcaagtgccggccctgtggaagtggagtccactacacaccacagcagaacggactcaagacgaccagagtctccatcactgacctcctagcacacaccaattacacgtttgagatctgggcagtgaatggagtgtctaagtataaccctagcccggaccagtccgtgtctgtcacagtgacaaccaaccaagcagcaccatcatccattgctttggcccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctctgacttcctatgtttttcacgtgcgagccaggaccgctgctggctacggagacttcagcgagcccctggaagtcactactaatacagtgccttcccgcatcattggcgatggagccaactccactgtcctgctggtctccgtctctggcagtgtggtcctcgtggtcattctcattgcagcttttgtgatcagccgaaggtaa

SEQ ID NO: 18 - protein, 574 aa, Mus musculus
RTMAGIFYFILFSFLFGICDAVTGSRVYPANEVTLLDSRSVQGELGWIASPLEGGWEEVSIMDEKNTPIRTYQVCNVMEASQNNWLRTDWITREGAQRVYIEIKFTLRDCNSLPGVMGTCKETFNLYYYESDNDKERFIRESQFGKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDASCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNGVSKYNPSPDQSVSVTVTTNQAAPSSIALAQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRR

SEQ ID NO: 19 - DNA, 2961 bp, Monodelphis domestica
  CDS (1)..(2958)
atggctgggattttatatttcattctcttttcgtttctatttgggatttgcaatggtgtcaccggttctaggatatatcccgccaatgaagttactttattggattccagatcggttcagggagaacttgggtggatagccagccctttggaaggagggtgggaagaagtgagcattatggatgagaaaaatactccaatccgtacctaccaagtctgcaatgtgatggagtccagccaaaacaactggttacgaactgattggattcctcgggaaggggctcagagggtgtatatcgagattaaattcacactgagggactgcaatagcctaccaggagttatgggaacttgcaaagagacttttaacttgtactactatgaatccaacaatgataaagaacgctttattagagagagccagtttgccaagatcgacaccattgctgctgatgagagcttcacccaagtggacattggtgacagaatcatgaagttgaacactgagatacgagatgtgggaccattgagtaagaaagggttctatttggcttttcaagatgttggagcttgtattgccctagtatctgttcgggttttctataagaagtgcccattgacagttcgcaatctggctcaatttccagacaccatcactggggctgatacatcctccctagtggaagttcgaggctcttgtgtcaacaactcagaagagaaggatgtgccaaaaatgtattgtggggcagatggtgaatggctggtacccattggcaactgtctatgcaatgctgggcatgaagagagaaatggagaatgccaagcctgcaagattggatactataaggccctttccactgatactgcctgtgccaagtgcccaccccacagctactccgtctgggagggatccacctcctgcacctgtgaccgaggctattttcgagcagaggatgatgcggcttccatgccctgcactcgcccaccatctgctcccctcaacttgatttcgaatgtcaatgaaacatcagtgaacttggagtggagcagtcctgagaacactgggggccgtcaagacatttcctacaacgtagtgtgcaagaagtgtggtgctggagaggtcaaccgatgtggatcctgcggcagtggagtccactatacaccccagcagaatggcctcaagagcaccaaagtctccatcaccgacctcctggcacatactaactatacttttgaaatcttggctgtgaatggagtgtccaagtacaatccgagtcaggaccaatcagtttcagttactgtgacgacaaaccaagcagctccgtcttccatcgctttgatccaggctaaagaaataacgagatacagtgttgcattggcttggctggaacctgatcggccaaatggagtcatcttagagtatgaagtcaaatattatgagaaggatcagaatgaacgcagctataggattgttcgaacagcctccaggaacactgacatcaaaggcttgaatcccttgacttcctatgtattccatgtgagagcccgaacagcagctggctatggagacttcagtgaaccctttgaggtcacaactaacacagtgccttctcgaatcattggagatggaaccaactccacagtccttctggtgtccgtttcgggcagcgtggttctggtggtcatcctcattgcagccttcgtcatcagccggagacggagtaaatacagtaaggcaaagcaggaagcagatgaagagaaacatttgaatcaaggtgtgagaacctatgttgacccttttacatatgaagatcccaaccaagctgttcgagagtttgccaaagaaattgatgcctcctgcattaagatagaaaaagttataggagtgggtgaatttggtgaagtgtgcagtgggcgactcaaagtacctgggaagagagagatctgtgtggctattaagactcttaaagctgggtatacagacaaacagaggagggatttcctaagtgaagccagcatcatgggacagtttgaccacccaaatatcatccacttagaaggcgtagttaccaaatgtaaacctgtaatgatcataaccgagtacatggagaatggctccttggatgcattcctgaggaagaatgatggaagatttacagtgattcagttggttgggatgcttcgtggcattggttctgggatgaaatacctctctgatatgagctatgtgcatagagatctagctgcccggaacatcttggtcaatagcaacttggtctgcaaagtatctgactttggcatgtctcgtgttcttgaagatgatcctgaagcagcttacacaaccaggggtggcaagattcccatccggtggactgcaccagaagcgattgcttatcgtaaattcacatccgcgagtgatgtatggagctatggaattgtgatgtgggaagtgatgtcgtatggagagcggccttactgggatatgtccaaccaggatgttataaaagccattgaagaaggctaccggctacctccaccaatggactgccccatcgctctccaccagctgatgctagactgctggcagaaggaaagaagtgacagacctaaatttggacagattgtcaacatgttggacaaactcattcgcaaccccaacagcttgaagaggacgggtactgagagctccaggcccaatactgctctgttggatcctagctctcccgagttctctgctgtggtatctgtaggtgattggcttcaggccattaaaatggaccggtataaggacaacttcacagctgccggttacaccaccctcgaggctgtggtgcacatgaaccaggacgacctggcgagaatcggtatcacggccgtcacgcaccagaataagatcttgaacagcgtccaggcaatgcggacccaaatgcaacagatgcatggcaggatggttcctgtctga

SEQ ID NO: 20 - protein, 986 aa, Monodelphis domestica
MAGILYFILFSFLFGICNGVTGSRIYPANEVTLLDSRSVQGELGWIASPLEGGWEEVSIMDEKNTPIRTYQVCNVMESSQNNWLRTDWIPREGAQRVYIEIKFTLRDCNSLPGVMGTCKETFNLYYYESNNDKERFIRESQFAKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERNGECQACKIGYYKALSTDTACAKCPPHSYSVWEGSTSCTCDRGYFRAEDDAASMPCTRPPSAPLNLISNVNETSVNLEWSSPENTGGRQDISYNVVCKKCGAGEVNRCGSCGSGVHYTPQQNGLKSTKVSITDLLAHTNYTFEILAVNGVSKYNPSQDQSVSVTVTTNQAAPSSIALIQAKEITRYSVALAWLEPDRPNGVILEYEVKYYEKDQNERSYRIVRTASRNTDIKGLNPLTSYVFHVRARTAAGYGDFSEPFEVTTNTVPSRIIGDGTNSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHMNQDDLARIGITAVTHQNKILNSVQAMRTQMQQMHGRMVPV

SEQ ID NO: 21 - DNA, 3084 bp, Canis familiaris
  CDS (1)..(3081)
atgggaaagatcggaaagtcatccatcatgcccgtgacatacatcacacccaacaacagcccaaagccacgagatgtcacgcccgcgggacagattcactcggtgacaggcagtgacagtcagagcccaacaaggatgccagtgccaccagatgttgccgaagctcataaactgggtcagcacaaccacgctgttgcaagaggttccgaacaaataaccttattggattccagatctgttcagggagaacttgggtggatagcgagccctctggaaggagggtgggaggaagtgagtatcatggatgaaaaaaacacaccaatccgaacctaccaagtgtgcaacgtgatggaacccagccagaataactggctccgaactgattggatcacccgagaaggggcgcagagggtgtacattgaaatcaagttcacattgagagactgcaacagccttccaggtgtcatgggcacttgcaaggagacgttcaacctctactactatgaatcagacaacgacaaagagcgttttatccgagagagccagtttgccaagattgacaccatcgctgctgacgagagcttcacccaggtggacattggtgacaggatcatgaagctgaacaccgagatccgggatgtagggccgttgagcaaaaaggggttttatctggcttttcaggatgtgggggcttgcatcgccctggtgtcagtccgtgtgttctataagaagtgtccgctcaccgtccgcaatctggcccagtttccagacaccatcacgggggctgatacgtcttccctggtggaggttcgaggctcctgtgtcaacaactcagaagagaaggatgtgccaaaaatgtactgtggggcagatggtgaatggctggtacccattggcaactgcctatgcaatgctgggcacgaagagcgaaatggagaatgccaagcctgcaaaattgggtattacaaggccctctccacggatgcggcctgtgccaagtgcccgccccacagctattcggtctgggaaggagccacatcgtgtacctgtgaccgaggctttttcagagccgacaacgacgccgcctccatgccctgcacccgcccaccgtctgctcccctcaacctgatttcaaatgtcaacgagacttcggtgaatttggaatggagcagtccccagaacacaggtggccgccaggatatttcctacaatgtggtgtgcaagaaatgtggagctggtgattccagcaagtgccgaccctgtggaagtggggtccactataccccacagcagaatggcctgaagaccaccaaagtttccatcactgacctcctggctcacaccaattacaccttcgaaatctgggcggtgaatggagtgtccaagtacaaccccagcccagaccaatcagtgtccgtcactgtgacgaccaaccaagcagcaccatcatccattgccttggtccaggcgaaagaagttacaagatacagtgttgctctggcttggctggaaccagatcggcccaatggggtgatcttggagtatgaagtcaagtattatgagaaggatcagaatgagcgaagctaccggattgtccggacggccgccaggaacacagatatcaaaggcctgaatcctctgacttcctacgtgttccatgtccgagccaggacagcagctggctacggcgacttcagcgagcccctggaggtcacaaccaacacagtgccttcccggatcatcggagatggggccaactccacggtccttctggtctcagtctcaggcagtgtggtgctggtggtcattctcatcgcggcctttgtcatcagcaggagacggagtaaatacagtaaagctaaacaagaagcagatgaagagaaacatttgaatcaaggtgttagaacttatgtggatccctttacatatgaagatcccaaccaagcagttcgagaatttgccaaagaaatcgacgcctcctgcattaagattgaaaaagtcataggagttggtgaatttggcgaagtatgcagcgggcgtctcaaagtgcctggcaagagagagatctgtgtagccatcaagacactgaaagctggttatacagacaaacagaggagagacttcctgagtgaggccagcatcatgggacagtttgaccacccgaacataattcacttggaaggcgttgtcaccaaatgtaaaccagtaatgatcataacagagtacatggagaatggctccttggatgcattcctcaggaagaatgatggcagatttactgtcattcagctggtgggcatgcttcgtggcatcgggtctgggatgaagtacttatctgatatgagctatgtgcatcgagatctagctgcacggaacattctggtcaatagcaacttggtctgcaaagtgtctgattttggcatgtcgcgagtgcttgaggatgatccggaagcagcttacaccaccaggggtggcaagattcctatccggtggaccgcgccagaagcaattgcctatcgtaaattcacatcagcgagtgatgtatggagctatggaatcgttatgtgggaagtgatgtcgtatggagagagaccctattgggatatgtccaatcaagacgtgattaaagccattgaggaaggctatcggctcccccctccaatggactgccccatcgccctccatcagctgatgctagactgctggcagaaggagagaagtgacaggccgaaattcgggcagattgtcaacatgttggacaaactcatccgcaaccccaacagcttgaagaggacgggaactgagagctccagacctaacactgccttgttggacccaagctcccctgaattctccgccgtggtatcagtgggcgattggctccaggccattaaaatggaccgatataaggataacttcacggctgctggttataccacactagaggctgtagtgcacatgaaccaggaggacctggcgaggatcggcatcacggccgtcacacaccagaacaagattttgagcagcgtccaggcgatgagaacccaaatgcaacagatccacggcaggatggttcccgtctga

SEQ ID NO: 22 - protein, 1027 aa, Canis familiaris
MGKIGKSSIMPVTYITPNNSPKPRDVTPAGQIHSVTGSDSQSPTRMPVPPDVAEAHKLGQHNHAVARGSEQITLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRESQFAKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERNGECQACKIGYYKALSTDAACAKCPPHSYSVWEGATSCTCDRGFFRADNDAASMPCTRPPSAPLNLISNVNETSVNLEWSSPQNTGGRQDISYNVVCKKCGAGDSSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHMNQEDLARIGITAVTHQNKILSSVQAMRTQMQQIHGRMVPV

SEQ ID NO: 23 - DNA, 2961 bp, Pan troglodytes
  CDS (1)..(2958)
atggctgggattttctatttcgccctattttcgtgtctcttcgggatttgcgacgctgtcacaggttccagggtgtaccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaggatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccgtctgctcccctgaacttgatttcaaatgtcaatgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccgcagcagaatggcttgaagaccaccaaagtctccatcactgacctcctagctcacaccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggctaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 24 - protein, 986 aa, Pan troglodytes; identical to SEQ ID NO: 6

SEQ ID NO: 25 - DNA, 2964 bp, Pan troglodytes
  CDS (1)..(2961)
atggctgggattttctatttcgccctattttcgtgtctcttcgggatttgcgacgctgtcacaggttccagggtgtaccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaggatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccgtctgctcccctgaacttgatttcaaatgtcaatgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccgcagcagaatggcttgaagaccaccaaagtctccatcactgacctcctagctcacaccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggctaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggttgggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 26 - protein, 987 aa, Pan troglodytes
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRLGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 27 - DNA, 2784 bp, Pan troglodytes
  CDS (1)..(2781)
atggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaggatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccgtctgctcccctgaacttgatttcaaatgtcaatgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccgcagcagaatggcttgaagaccaccaaagtctccatcactgacctcctagctcacaccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggctaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 28 - protein, 927 aa, Pan troglodytes [sequence omitted]

SEQ ID NO: 29 - DNA, 2907 bp, Pan troglodytes
  CDS (1)..(2904)
atggctgggattttctatttcgccctattttcgtgtctcttcgggatttgcgacgctgtcacaggttccagggtgtaccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaggatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccgtctgctcccctgaacttgatttcaaatgtcaatgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccgcagcagaatggcttgaagaccaccaaagtctccatcactgacctcctagctcacaccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggctaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggacagtgtccaggcaatgcgaacccaaatgcagcagatgcacggcagaatggttcccgtctga

SEQ ID NO: 30 - protein, 968 aa, Pan troglodytes
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQDSVQAMRTQMQQMHGRMVPV

SEQ ID NO: 31 - DNA, 3015 bp, Pan troglodytes
  CDS (1)..(3012)
atggctgggattttctatttcgccctattttcgtgtctcttcgggatttgcgacgctgtcacaggttccagggtgtaccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaggatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccgtctgctcccctgaacttgatttcaaatgtcaatgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccgcagcagaatggcttgaagaccaccaaagtctccatcactgacctcctagctcacaccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacaggtaacaaggaccacccagactcagtcacttctgagctaatttttgtatgtttagctgtagtcactggggtctctgttttgctaagttggttcctgctttgcaaacaacggagtaaatacagtaaagccaaacaagaagcggatgaagagaaacatttgaatcaagctccgcctccctggttcacaccattctcccacctcagcctcctgagtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccaggcaagtggtgactcacttaaattcctgccttttcatcagaggccacttcatggctctctgcaacctgggtgtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 32 - protein, 1004 aa, Pan troglodytes
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTGNKDHPDSVTSELIFVCLAVVTGVSVLLSWFLLCKQRSKYSKAKQEADEEKHLNQAPPPWFTPFSHLSLLSVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRQVVTHLNSCLFIRGHFMALCNLGVGDWLQAIKMDRYKDNFTAAGYTTLEAVVHVNQEDLARIGITAITHQNKILSSVQAMRTQMQQMHGRMVPV

SEQ ID NO: 33 - DNA, 2958 bp, Pan troglodytes
  CDS (1)..(2955)
atggctgggattttctatttcgccctattttcgtgtctcttcgggatttgcgacgctgtcacaggttccagggtgtaccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaggatgtgccaaaaatgtactgtggggcagatggtgaatggctggtacccattggcaactgcctatgcaacgctgggcatgaggagcggagcggagaatgccaagctagaccttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccgtctgctcccctgaacttgatttcaaatgtcaatgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccgcagcagaatggcttgaagaccaccaaagtctccatcactgacctcctagctcacaccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagaagagggaagtagcttgcagcggctcatgcacactcagccaattcttctcctcacgccggttgtctgctctgttatctcggactataaatgtttaaatgggacaagaacaggtgaacagagaggagacaggtatattcagccaacttatcatgtttatcactcaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggttgggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 34 - protein, 985 aa, Pan troglodytes
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQARPCKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKNERSYRIVRTAARNTDIKGLNPLTSYVFHVRARTAAGYGDFSEPLEVTTNTEEGSSLQRLMHTQPILLLTPVVCSVISDYKCLNGTRTGEQRGDRYIQPTYHVYHSGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRLGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 35 - DNA, 2961 bp, Macaca mulatta
  CDS (1)..(2958)
atggctgggattttctatttcgccctcttttcgtgtctcttcgggatttgcgacgctgtcaccggttccagggtgtaccccgcgaatgaagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggccaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 36 - protein, 986 aa, Macaca mulatta
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 37 - DNA, 2907 bp, Macaca mulatta
  CDS (1)..(2904)
atggctgggattttctatttcgccctcttttcgtgtctcttcgggatttgcgacgctgtcaccggttccagggtgtaccccgcgaatgaagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggccaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggacagcgtccaggcaatgcgaacccaaatgcagcagatgcacggcagaatggttcctgtctga

SEQ ID NO: 38 - protein, 968 aa, Macaca mulatta
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQDSVQAMRTQMQQMHGRMVPV

SEQ ID NO: 39 - DNA, 2925 bp, Macaca mulatta
  CDS (1)..(2922)
atggctgggattttctatttcgccctcttttcgtgtctcttcgggatttgcgacgctgtcaccggttccagggtgtaccccgcgaatgaagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggccaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtccccacagggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 40 - protein, 974 aa, Macaca mulatta
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSPQGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 41 - DNA, 2979 bp, Macaca mulatta
  CDS (1)..(2976)
atggctgggattttctatttcgccctcttttcgtgtctcttcgggatttgcgacgctgtcaccggttccagggtgtaccccgcgaatgaagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggccaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtcatgtttattacttaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 42 - protein, 992 aa, Macaca mulatta
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGHVYYLGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 43 - DNA, 3036 bp, Macaca mulatta
  CDS (1)..(3033)
atggctgggattttctatttcgccctcttttcgtgtctcttcgggatttgcgacgctgtcaccggttccagggtgtaccccgcgaatgaagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggccaactccacagtccttctggtctctgtctcaggcagtgtggtgctggtggtaattctcattgcagcttttttttcctgctgccattcaggtgatcagcctctgatgtcattagctgtcgtcactggagtctctgttttgctaagttgtaaatacagtaaagccaaacaagaagcggatgaagagaaacatttgaatcaaggtcatgtttattacttaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 44 - protein, 1011 aa, Macaca mulatta
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFFSCCHSGDQPLMSLAVVTGVSVLLSCKYSKAKQEADEEKHLNQGHVYYLGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 45 - DNA, 2970 bp, Macaca mulatta
  CDS (1)..(2967)
atggctgggattttctatttcgccctcttttcgtgtctcttcgggatttgcgacgctgtcaccggttccagggtgtaccccgcgaatgaagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagaatcatttaaatcaaatggggccaactccacagtccttctggtctctgtctcaggcagtgtggtgctggtggtaattctcattgcagcttttgtcatcagccggagctgccagtatagaacaacacattctgtacaggcatctattttacattgtccaacttatcatgtttattacttaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 46 - protein, 989 aa, Macaca mulatta
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTESFKSNGANSTVLLVSVSGSVVLVVILIAAFVISRSCQYRTTHSVQASILHCPTYHVYYLGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 47 - DNA, 2961 bp, Gallus gallus
  CDS (1)..(2958)
atggccggggtccccgtcggcgcgctcctcccgctcctcgtcggcgtctgcggggccgtcaccggctcccgcgtgtaccccgccaacgaagtgaccctgctggactcccgctcggtgcagggggagctgggctggatcgcgagcccgctggaaggagggtgggaggaagtgagcataatggatgagaagaacactccgatccgcacctaccaagtttgcaatgtgatggagcccagtcagaataattggttacgaactgattggattccccgcgagggggctcagagggtatatattgaaatcaagttcacgctgagagactgcaacagcctgccaggtgtcatgggaacttgcaaagagactttcaacctctattactatgaatcaaacaacgacaaggagcgttttattcgagagagccagtttgccaagattgacaccattgctgctgatgagagcttcacccaggtggacattggtgacaggatcatgaagctgaatacagaggtgcgggacgtggggcctctcagcaagaaagggttttacttggctttccaggacgtcggtgcctgcattgctttggtgtctgttcgtgtcttctataagaagtgcccactgacagttcgaaacctggcacagtttccagacaccattactggggctgatacatcctctctggtggaggttcgtggctcctgtgtcaacaactcggaagagaaggacgtgccaaaaatgtactgcggggcagatggtgaatggctggtacccattggcaactgtctgtgcaatgctggctatgaagaacgcaatggtgaatgccaagcttgcaaaatcggatactacaaggcgctctcaacagatgttgcatgtgccaaatgcccgcctcacagctactccatctgggaaggctctacctcctgcacctgtgatcggggcttcttccgagcagaaaatgatgctgcatccatgccctgcactcgccctccatccgcaccccagaacctgatttccaacgtcaacgagacgtcagtgaacttggagtggagcgccccacagaacaagggaggacgggacgacatctcctacaacgtggtgtgcaagcgctgcggggcaggggagcccagccactgccggtcctgtggcagtggtgtacatttcagcccccagcagaacgggctgaaaaccacgaaggtttccatcactgacctcctggcacacaccaactacacctttgaggtctgggcagtgaatggagtgtccaagcacaaccccagccaggaccaagctgtgtcagtcactgtgacaactaaccaagcagctccatccccaattgcattgatccaggctaaagagataacgaggcacagcgttgccttggcctggctggaacctgacaggcccaatggagtcatcctggagtatgaagtcaagtactatgaaaaggaccaaaacgagcgcagctatcgcattgtgaagacagcctccaggaatactgacatcaaaggtttgaaccccctgacttcatatgtatttcatgtgcgggccaggacagcagcaggatacggagacttcagtgggccgtttgagttcacaactaacacagttccttcccccatcattggcgatggtaccaatcccacagtgctgcttgtttcagtggctggcagtgttgttctcgtggtcattctcattgcagcctttgtcatcagcaggaggcgcagcaaatacagtaaagctaagcaagaggcagatgaggagaaacatttgaaccaaggtgtcagaacatatgtggatccttttacatatgaggatccaaatcaagctgtgagggaatttgccaaagaaattgatgcctcctgcataaagattgagaaagttattggtgtgggggaatttggtgaagtatgcagtggacgtctcaaagttccaggaaaaagagaaatctgtgtggctatcaagactctgaaagctggttacactgacaaacaacggagagacttcctgagtgaggccagcatcatgggacaatttgaccaccccaatatcatccacttggaaggcgttgttactaaatgtaaaccagtaatgatcataactgagtacatggagaatggctccttggatgccttcctccggaagaatgatggcagatttacagtaatccagttggtggggatgcttcgtggcatcggctcaggaatgaagtatctgtctgacatgagctatgtgcatcgggatctagctgctcgaaacatactggtcaacagcaacttggtctgcaaagtgtctgacttcggcatgtcccgtgtcctggaagatgaccctgaggcagcttataccacacggggtggcaagatccctatccgatggactgcaccagaggcaattgcctaccgtaaatttacatcggctagtgacgtgtggagctatggcatcgtcatgtgggaagtgatgtcctatggagagagaccttactgggatatgtccaatcaagacgttattaaagccattgaggaagggtatcggttgccacccccaatggactgccccattgctctccatcagctgatgttagactgctggcagaaggaacgcagcgacagacctaaatttggacagattgtcaacatgctggacaaactcatccgcaaccctaacagcctgaagaggacaggcagcgagagctccagacccagcacagccctgctggatcccagctccccggagttctcggcggttgtttctgtcagtgactggctccaagccattaaaatggagcgatacaaggataacttcacagctgctggctataccaccctagaggctgtggtgcatatgaaccaggacgacctggccaggatcgggatcactgccatcacacaccagaacaagatcttgagcagcgttcaagccatgcgcagccaaatgcaacagatgcacggcaggatggtgcccgtctga

SEQ ID NO: 48 - protein, 986 aa, Gallus gallus
MAGVPVGALLPLLVGVCGAVTGSRVYPANEVTLLDSRSVQGELGWIASPLEGGWEEVSIMDEKNTPIRTYQVCNVMEPSQNNWLRTDWIPREGAQRVYIEIKFTLRDCNSLPGVMGTCKETFNLYYYESNNDKERFIRESQFAKIDTIAADESFTQVDIGDRIMKLNTEVRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGYEERNGECQACKIGYYKALSTDVACAKCPPHSYSIWEGSTSCTCDRGFFRAENDAASMPCTRPPSAPQNLISNVNETSVNLEWSAPQNKGGRDDISYNVVCKRCGAGEPSHCRSCGSGVHFSPQQNGLKTTKVSITDLLAHTNYTFEVWAVNGVSKHNPSQDQAVSVTVTTNQAAPSPIALIQAKEITRHSVALAWLEPDRPNGVILEYEVKYYEKDQNERSYRIVKTASRNTDIKGLNPLTSYVFHVRARTAAGYGDFSGPFEFTTNTVPSPIIGDGTNPTVLLVSVAGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPSTALLDPSSPEFSAVVSVSDWLQAIKMERYKDNFTAAGYTTLEAVVHMNQDDLARIGITAITHQNKILSSVQAMRSQMQQMHGRMVPV

SEQ ID NO: 49 - DNA, 2961 bp, Xenopus laevis
  CDS (1)..(2958)
atggctgggattgtacatggcatcttgttttgtggcctctttggactttgttgggcagtgacgggatctaggatttacccagccagtgaagttaccctgctggattccaggtcagtgcaaggagagcttggctggatagcaagtcctttggaaggagggtgggaagaagtgagtatcatggatgaaaagaatacacctatacgaacttaccaagtctgcaatgtcatggaatcgagccaaaacaactggttacggactgactggattccccgaagtggagctcagagagtatatgttgaaattaaatttacattaagggactgcaacagcttgcctggggtaatgggtacctgcaaagagacctttaatctgtattattatgagtccaacaatgacaaagagcgtttcattcgtgaaacccagtatgtgaaaatcgataccattgcagccgatgagagcttcacccaggttgatattggggaccgtattatgaagctgaacactgaggttagagatgttggtccactcagtaagaagggcttctacttggccttccaggatgtgggagcatgcattgcccttgtgtctgtccgagtgttctacaagaagtgtccattgactgtaagaaacttggcacagttccctgacaccattacaggttcagacacctcttctttggtggaagttcgaggctcttgtgtagacaactcagaagagaaagatgtgcctaagatgtactgtggtgctgatggagagtggctggtgcccattggaaactgcttatgtaacgctgggtttgaggagcacaatggaggatgccaagcctgcaaagttggatactacaaagccctctcaacagatgcagcttgctccaagtgtcccccacacagttatgctctccgggaaggctcaacctcctgcacctgtgaccgtggctattttcgagctgacactgacccggcttctatgccctgcactagacccccatctgctcctcagaacctaatctcaaacgtcaatgagacatctgtgaatttggagtggagtccgccacaaaattctggtggaaggcctgatgtctcctacaatttggtctgtaaaaggtgcggctctgacctgactcgctgtcggccttgtggcagtggagtgcactatagcccccagcaaaatggcctgaagactaccaaagtgtccattaatgacctgcaagcccatactaactacacctttgaggtctgggccattaatggtgtctccaagcagaaccctgaacaagatcaggctgtgtcagttactgtgaccaccaaccaagctgctccttcaactgtaacccagatacagccaaaagagatcaccaggcacagtgtgtctttgacttggccagagcctgagcgagccaatggggtcatcctggaatacgaagtcaagtattatgagaaggaccagaatgagcgtagttatcgaattgttaagacggcctcgcgaagtgcagacatcaaaggtctcaacccccttactggttatgtgttccatgttcgtgctcggacagctgcaggatatggggagttcagtggaccctttgagttcaccacgaatacagtgccatccccgatgattggcgaaggaaccagccccactgtgcttttggtgtccgtggctggaagcattgtccttgtggtcattctcattgctgcttttgtcatcagcagaagacggagtaaatacagtaaagccaagcaggaagcagacgaggaaaaacatttaaaccaaggagtaaagacttatgtggacccatttacatatgaagatcctaaccaggctgtccgcgaatttgcaaaggaaatcgatgcctcttgtattaagatcgaaaaagtaattggagtaggtgaatttggtgaagtgtgcagtgggcgtctgaaggtccctggaaagagagagatttatgttgcaattaagaccctgaaagctggttacaccgataagcagaggagagactttctcagtgaggccagcatcatgggtcagtttgaccatcctaacatcatccaccttgaaggtgttgtcaccaaatgcaagccagtgatgataatcaccgagtacatggagaacggatccttggatgcattccttcggaagaatgatggtcggtttacagtaatacagcttgtgggaatgctgcgtggcattgggtctggaatgaaatacctttcggacatgagttatgtgcaccgggacctagctgctcgtaatatccttgtgaacagcaacctagtctgtaaggtctctgactttggcatgtctcgggtgctggaagatgaccctgaagcagcctacacaaccaggggtggcaagatcccaatccgatggactgcaccagaagctattgcatacaggaaattcacttctgctagtgatgtctggagctatggcattgtcatgtgggaagtcatgtcttatggagagaggccttactgggatatgtccaatcaagatgtaattaaagcaatcgaggaaggatacaggctgcccccgcctatggactgccctattgcactgcatcagctcatgttggactgctggcagaaggatcgtagtgaccgaccaaaatttgggcagatagtcagcatgctggataaactcatcaggaacccaaacagtttgaaaaggactgggctggagaattcaagcagaacaaatacggctctgctggaccccagttcgcctgaatggtcccaggtggcttctgtgcttgattggctgcaggccatcaaaatggaaagatacaaagataacttcacagcagccggatacaccagcttggaagcagtcgtgcatgtgaatcaagatgacttgaccaggattggcattagttccccttcacaccagaacaagatcctgagcagcgtccaaggaatgaggacccagttgcagcaaatgcaaggcaggatggttcctgtttga

SEQ ID NO: 50 - protein, 986 aa, Xenopus laevis
MAGIVHGILFCGLFGLCWAVTGSRIYPASEVTLLDSRSVQGELGWIASPLEGGWEEVSIMDEKNTPIRTYQVCNVMESSQNNWLRTDWIPRSGAQRVYVEIKFTLRDCNSLPGVMGTCKETFNLYYYESNNDKERFIRETQYVKIDTIAADESFTQVDIGDRIMKLNTEVRDVGPLSKKGFYLAFQDVGACIALVSVRVFYKKCPLTVRNLAQFPDTITGSDTSSLVEVRGSCVDNSEEKDVPKMYCGADGEWLVPIGNCLCNAGFEEHNGGCQACKVGYYKALSTDAACSKCPPHSYALREGSTSCTCDRGYFRADTDPASMPCTRPPSAPQNLISNVNETSVNLEWSPPQNSGGRPDVSYNLVCKRCGSDLTRCRPCGSGVHYSPQQNGLKTTKVSINDLQAHTNYTFEVWAINGVSKQNPEQDQAVSVTVTTNQAAPSTVTQIQPKEITRHSVSLTWPEPERANGVILEYEVKYYEKDQNERSYRIVKTASRSADIKGLNPLTGYVFHVRARTAAGYGEFSGPFEFTTNTVPSPMIGEGTSPTVLLVSVAGSIVLVVILIAAFVISRRRSKYSKAKQEADEEKHLNQGVKTYVDPFTYEDPNQAVREFAKEIDASCIKIEKVIGVGEFGEVCSGRLKVPGKREIYVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKDRSDRPKFGQIVSMLDKLIRNPNSLKRTGLENSSRTNTALLDPSSPEWSQVASVLDWLQAIKMERYKDNFTAAGYTSLEAVVHVNQDDLTRIGISSPSHQNKILSSVQGMRTQLQQMQGRMVPV

SEQ ID NO: 51 - DNA, 2958 bp, Xenopus laevis
  CDS (1)..(2955)
atggctgggattgtacatggcatcttgttttgtggcctctttggactttgttgggcagtgacgggatctaggatttacccagccagtgaagttaccctgctggattccaggtcagtgcaaggagagcttggctggatagcaagtcctttggaaggagggtgggaagaagtgagtatcatggatgaaaagaatacacctatacgaacttaccaagtctgcaatgtcatggaatcgagccaaaacaactggttacggactgactggattccccgaagtggagctcagagagtatatgttgaaattaaatttacattaagggactgcaacagcttgcctggggtaatgggtacctgcaaagagacctttaatctgtattattatgagtccaacaatgacaaagagcgtttcattcgtgaaacccagtatgtgaaaatcgataccattgcagccgatgagagcttcacccaggttgatattggggaccgtattatgaagctgaacactgaggttagagatgttggtccactcagtaagaagggcttctacttggccttccaggatgtgggagcatgcattgcccttgtgtctgtccgagtgttctacaagaagtgtccattgactgtaagaaacttggcacagttccctgacaccattacaggttcagacacctcttctttggtggaagttcgaggctcttgtgtagacaactcagaagagaaagatgtgcctaagatgtactgtggtgctgatggagagtggctggtgcccattggaaactgcttatgtaacgctgggtttgaggagcacaatggaggatgccaagcctgcaaagttggatactacaaagccctctcaacagatgcagcttgctccaagtgtcccccacacagttatgctctccgggaaggctcaacctcctgcacctgtgaccgtggctattttcgagctgacactgacccggcttctatgccctgcactagacccccatctgctcctcagaacctaatctcaaacgtcaatgagacatctgtgaatttggagtggagtccgccacaaaattctggtggaaggcctgatgtctcctacaatttggtctgtaaaaggtgcggctctgacctgactcgctgttcgccttgtggcagtggagtgcactatagcccccagcaaaatggcctgaagactaccaaagtgtccattaatgacctgcaagcccatactaactacacctttgaggtctgggccattaatggtgtctccaagcagaaccctgaacaagatcaggctgtgtcagttactgtgaccaccaaccaagctgctccttcaactgtaacccagatacagccaaaagagatcaccaggcacagtgtgtctttgacttggccagagcctgagcgagccaatggggtcatcctggaatacgaagtcaagtattatgagaaggatcagaatgagcgtagttatcgaattgttaagacggcctcgcgaagtgcagacatcaaaggtctcaacccccttactggttatgtgttccatgttcgtgctcggacagctgcaggatatggggagttcagtggaccctttgagttcaccacgaatacagtgccatccccgatgattggcgaaggaaccagccccactgtgcttttggtgtccgtggctggaagcattgtccttgtggtcattctcattgctgcttttgtcatcagcagaagacggagtaaatacagtaaagccaagcaggaagcagacgaggaaaaacatttaaaccaaggagtaaagacttatgtggacccatttacatatgaagatcctaaccaggctgtccgcgaatttgcaaaggaaatcgatgcctcttgtattaagatcgaaaaagtaattggagtaggtgaatttggtgaagtgtgcagtgggcgtctgaaggtccctggaaagagagagatttatgttgcaattaagaccctgaaagctggttacaccgataagcagaggagagactttctcagtgaggccagcatcatgggtcagtttgaccatcctaacatcatccaccttgaaggtgttgtcaccaaatgcaagccagtgatgataatcaccgagtacatggagaacggatccttggatgcattccttcggaagaatgatggtcggtttacagtaatacagcttgtgggaatgctgcgtggcattgggtctggaatgaaatacctttcggacatgagttatgtgcaccgggacctagctgctcgtaatatccttgtgaacagcaacctagtctgtaaggtctctgactttggcatgtctcgggtgctggaagatgaccctgaagcagcctacacaacaaggggtggcaagatcccaatccgatggactgcaccagaagctattgcatacaggaaattcacttctgctagtgatgtctggagctatggcattgtcatgtgggaagtcatgtcttatggagagaggccttactgggatatgtccaatcaagatgtaattaaagcaatcgaggaaggatacaggctgcccccgcctatggactgccctattgcactacatcagctcatgttggactgctggcagaaggatcgtagtgaccgaccaaaatttgggcagatagtcagcatgctggataaactcatcaggaacccaaacagtttgaaaaggactgggctggagaattcaagaacaaacacggctctgctggaccccagttcgcctgaatggtcccaggtggcttctgtgcttgattggctgcaggcatcaaaatggaaaagatacaaagataacttcacagcggccggatacaccagcttggaagcagtcgtgcatgtgaatcaagatgacttgaccaggattggcattagttccccttcacaccagaacaagatcctgagcagcgtccaaggaatgaggacccagttgcagcaaatgcaaggcagaatggttcctgtttga

SEQ ID NO: 52 - protein, 985 aa, Xenopus laevis
MAGIVHGILFCGLFGLCWAVTGSRIYPASEVTLLDSRSVQGELGWIASPLEGGWEEVSIMDEKNTPIRTYQVCNVMESSQNNWLRTDWIPRSGAQRVYVEIKFTLRDCNSLPGVMGTCKETFNLYYYESNNDKERFIRETQYVKIDTIAADESFTQVDIGDRIMKLNTEVRDVGPLSKKGFYLAFQDVGACIALVSVRVFYKKCPLTVRNLAQFPDTITGSDTSSLVEVRGSCVDNSEEKDVPKMYCGADGEWLVPIGNCLCNAGFEEHNGGCQACKVGYYKALSTDAACSKCPPHSYALREGSTSCTCDRGYFRADTDPASMPCTRPPSAPQNLISNVNETSVNLEWSPPQNSGGRPDVSYNLVCKRCGSDLTRCSPCGSGVHYSPQQNGLKTTKVSINDLQAHTNYTFEVWAINGVSKQNPEQDQAVSVTVTTNQAAPSTVTQIQPKEITRHSVSLTWPEPERANGVILEYEVKYYEKDQNERSYRIVKTASRSADIKGLNPLTGYVFHVRARTAAGYGEFSGPFEFTTNTVPSPMIGEGTSPTVLLVSVAGSIVLVVILIAAFVISRRRSKYSKAKQEADEEKHLNQGVKTYVDPFTYEDPNQAVREFAKEIDASCIKIEKVIGVGEFGEVCSGRLKVPGKREIYVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKDRSDRPKFGQIVSMLDKLIRNPNSLKRTGLENSRTNTALLDPSSPEWSQVASVLDWLQASKWKRYKDNFTAAGYTSLEAVVHVNQDDLTRIGISSPSHQNKILSSVQGMRTQLQQMQGRMVPV

SEQ ID NO: 53 - DNA, 2961 bp, Xenopus laevis
  CDS (1)..(2958)
atggctgggattgtacatggcatcttgttttgtggcctctttggactttgttgggcagtgacgggatctaggatttacccagccagtgaagttaccctgctggattccaggtcagtgcaaggagagcttggctggatagcaagtcctttggaaggagggtgggaagaagtgagtatcatggatgaaaagaatacacctatacgaacttaccaagtctgcaatgtcatggaatcgagccaaaacaactggttacggactgactggattccccgaagtggagctcagagagtatatgttgaaattaaatttacattaagggactgcaacagcttgcctggggtaatgggtacctgcaaagagacctttaatctgtattattatgagtccaacaatgacaaagagcgtttcattcgtgaaacccagtatgtgaaaatcgataccattgcagccgatgagagcttcacccaggttgatattggggaccgtattatgaagctgaacactgaggttagagatgttggtccactcagtaagaagggcttctacttggccttccaggatgtgggagcatgcattgcccttgtgtctgtccgagtgttctacaagaagtgtccattgactgtaagaaacttggcacagttccctgacaccattacaggttcagacacctcttctttggtggaagttcgaggctcttgtgtagacaactcagaagagaaagatgtgcctaagatgtactgtggtgctgatggagagtggctggtgcccattggaaactgcttatgtaacgctgggtttgaggagcacaatggaggatgccaagcctgcaaagttggatactacaaagccctctcaacagatgcagcttgctccaagtgtcccccacacagttatgctctccgggaaggctcaacctcctgcacctgtgaccgtggctattttcgagctgacactgacccggcttctatgccctgcactagacccccatctgctcctcagaacctaatctcaaacgtcaatgagacatctgtgaatttggagtggagtccgccacaaaattctggtggaaggcctgatgtctcctacaatttggtctgtaaaaggtgcggctctgacctgactcgctgtcggccttgtggcagtggagtgcactatagcccccagcaaaatggcctgaaaactaccaaagtgtccatcactgacctgcaagcccataccaactacacatttgaggtctggtccattaatggtgtctccaagcagaaccctggacaagatcaggccgtgtcagttactgtgaccaccaaccaagctgctccatcaactgtaacccagatacagccaaaagacatcaccaggcacagcgtgtctttgacttggccagagcctgagcgacccaatggcgtcatactggaatacgaagtcaagtattatgaaaaggaccagaatgagcgtacgtaccgcattgtgaagacaacctcgcggagtgcagacatcaaaggtctcaatccccttacggcctatgtgttccatgtccgtgctcgaactgctgcaggatatggggagtttagtggaccctttgagttcaccactaatacagtgccatcccctatgattggagaaggagccagccccactgtgcttttggtgtccgttgctggaagtattgtccttgtggttattctcattgctgcatttgtcatcagcagaaggcggagtaaatacagtaaagccaagcaagaagcagatgaggaaaaacatttaaaccaaggagtgaagacgtatgtggacccatttacttatgaagatcctaaccaggcagtccgtgaatttgcaaaggaaatcgatgcctcttgtattaagatcgaaaaagtcattggagtaggtgaatttggtgaagtttgtagtgggcgtctgaaggtccccggaaagagagagatttatgttgcaataaagactttgaaagctggttacaccgataagcagaggagagactttctaagtgaggccagcatcatgggtcagtttgaccatcccaacatcatccaccttgaaggtgttgtcaccaaatgcaagccagtgatgataattaccgagtacatggagaacggatccttggatgcattccttcgaaagaatgacgggcggtttacggtgatacagcttgtgggaatactgcgtggcattgggtctggaatgaaatacctctcagatatgagttatgtacatcgggacctagctgctcgtaatatccttgtgaacagcaatctagtctgtaaggtctctgacttcggcatgtctcgagtgctggaagatgaccctgaagcagcctacacaaccaggggtggcaagatcccgatccgatggacagcaccagaagctattgcgtacaggaaattcacctctgccagcgatgtctggagctatggcattgtcatgtgggaagtcatgtcttatggagagaggccctactgggatatgtccaatcaagacgttattaaagcaatcgaggaaggatacaggctgcccccaccaatggactgccctatcgcactgcatcagctcatgttggactgctggcagaaggagcgtagtgaccgaccaaagtttgggcaaatagtcagcatgctggataagctcatcaggaacccaaacagtttgaaaaggactggtctggacaattcaagcagaacaaatacgactctgctggaccccagctcgcctgaatggtcccaggtggcttctgtgcttgattggctgcaggccatcaaaatggaaagatacaaagataacttcacagcggccggatacaccagcttggaagcagtcgtgcatgtaaatcaagatgacctgaccaggattggcattagttccccttcacaccagaacaagattctgagcagtgttcagggaatgaggacccagatgcagcaaattcaaggcaggatggttcctgtttga

SEQ ID NO: 54 - protein, 986 aa, Xenopus laevis
MAGIVHGILFCGLFGLCWAVTGSRIYPASEVTLLDSRSVQGELGWIASPLEGGWEEVSIMDEKNTPIRTYQVCNVMESSQNNWLRTDWIPRSGAQRVYVEIKFTLRDCNSLPGVMGTCKETFNLYYYESNNDKERFIRETQYVKIDTIAADESFTQVDIGDRIMKLNTEVRDVGPLSKKGFYLAFQDVGACIALVSVRVFYKKCPLTVRNLAQFPDTITGSDTSSLVEVRGSCVDNSEEKDVPKMYCGADGEWLVPIGNCLCNAGFEEHNGGCQACKVGYYKALSTDAACSKCPPHSYALREGSTSCTCDRGYFRADTDPASMPCTRPPSAPQNLISNVNETSVNLEWSPPQNSGGRPDVSYNLVCKRCGSDLTRCRPCGSGVHYSPQQNGLKTTKVSITDLQAHTNYTFEVWSINGVSKQNPGQDQAVSVTVTTNQAAPSTVTQIQPKDITRHSVSLTWPEPERPNGVILEYEVKYYEKDQNERTYRIVKTTSRSADIKGLNPLTAYVFHVRARTAAGYGEFSGPFEFTTNTVPSPMIGEGASPTVLLVSVAGSIVLVVILIAAFVISRRRSKYSKAKQEADEEKHLNQGVKTYVDPFTYEDPNQAVREFAKEIDASCIKIEKVIGVGEFGEVCSGRLKVPGKREIYVAIKTLKAGYTDKQRRDFLSEASIMGQFDHPNIIHLEGVVTKCKPVMIITEYMENGSLDAFLRKNDGRFTVIQLVGILRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVSMLDKLIRNPNSLKRTGLDNSSRTNTTLLDPSSPEWSQVASVLDWLQAIKMERYKDNFTAAGYTSLEAVVHVNQDDLTRIGISSPSHQNKILSSVQGMRTQMQQIQGRMVPV

SEQ ID NO: 55 - DNA, 2961 bp, Danio rerio
  CDS (1)..(2958)
atggctgcgcttgtgttcacagcgacttttgcgctaataatctggataccgactttcgtattaaccgcacgggtctaccctcctaatgaagtgacactgctggactcgagaactgtgcaaggagaattgaaatgggttgcaagtccgacggaaggagggtgggaagaggtgagcatcatggatgagaagaatacgccaatcaggacgtaccaggtgtgcaacgtaatggaacccagccagaacaactggctccgaacggactggatcccccgtggcggagctcagcgggtctacatcgagatcaaattcaccctgcgtgactgcaacagcctgccaggagtcatgggaacctgcaaggagacctttaatctttactattatgagtccaacaatgacaaagagcgatacatccgagaaaaccagttcaccaaaatcgacaccattgcggctgatgaaagcttcacgcaggtggacataggagaccgcatcatgaagctgaacacggaggtgagggatgtggggattttgacaaggaagggcttctacctggccttccaggacgttggggcttgcattgccttggtatcagtacggatcttctacaagaaatgcccgcttactgtacgcaacctggcccaatttccagacaccaccaccggggcagacacctcatcgctagtggaggtacgcggatcctgtgtggacaattcggaggaacgtgaggtccctaaaatgtactgcggagcagatggagaatggctggtgcctattggaaactgtttgtgtaaccctggctatgaagaacatgaagggacatgtcaagcctgtaagatcggtaactacagagctctagccacagacggcagctgctctaagtgtcccctgcacagctactctgtgagagagggatctacttcctgtgcctgtgataaaggcttcttcaggtctgagacggaccctgcatctatgccctgcacacagcccccatctgctcctcagcacctcatttccaatgtgaacgagacttcggtaaatctggagtggacggctccagcatcctctggtggcagacaggaccttgcctataacgttatatgcaagcggtgcagctcggacggtcaacgctgtcagccctgcggcaatggcatccatttttcccctcagcagctgggtctacgcactacccgggtgtccataaatgacctgcaggctcacaccaactacaccttcgagatctgggcagtcaacggggtctccaaacagagtccwggacccgaacaagcagtctctgtgactgttaccaccaaccaagcggctccctctccagttaccaccatccaggccaaggacatcacaagacatgctgtgtctttggcatggcaacaacccgagagacccaatggagtcattcttgagtacgaggtcaaatactatgagaaggatcaaaacgagcgcagttatcgcataatgaagacttcgtcccgaagcgctgagatcaaaggcctgagcccactcacctcctacgtgtttcatgtgcgtgcccgcaccgctgctggctacggagaattcagtgccccttttgagttcatgaccaactcagttccttctcccatcatcggggacggagctaactccaccgtgctcttggtgtctgtgatcggcagtgtgattttgttgctcatcttcatcggcgtcttcatcatcagccgcaggagaagcaaatacagcaaagccaagcaggattctgatgaggagaggcatttacacccaggagtccggatctatgtggaccccttcacatacgaggaccccaaccaagcagtccgtgaattcgctaaagaaatcgacgcctcctgcatcaagatcgaaaaggtcatcggcattggagaattcggagaggtgtgcagtggccgtctcaagatgcctggaaagcgtgagatctgtgtggccataaaaaccctaaaggcaggatacaccgacaagcaaaggcgggattttctgagcgaggccagcatcatgggccagtttgaccaccctaacatcatccgattggagggagttgtcactaaatgtaagccagttatgatcatcacagagtacatggagaacggatcactggatgcttttcttaggaagaatgatggacggtttacagtgattcagctggtgggcatcctgcgaggcattgcttcaggaatgaaatatctctccgatatgagctatgtccatcgtgacttggcggctcgcaacattctggtcaacagcaacctggtgtgcaaagtgtccgactttggcatgtctcgagttttggaggaagacccagatgctgcttataccaccagaggaggcaagatacccattcgctggacggctcctgaagccattacttacaggaagttcacctccgcatctgacgtctggagctatggcatcgtcatgtgggaagtgatgtcatatggagagcggccatattgggacatgagcaaccaggatgtgataaaggccattgaggaaggctacaggctgcctcctcccatggactgtccagtttctttgcaccagttgatgttggattgctggcagaaagagcgcgcagaaaggccaaagttcagtcaaattgtcaacatgctggacaaactcatccgcaaccctaacagcctgaaaaggacaggaggagaaatagccagacccaacaccaccctcctggagcctagcagcccagaattcacgtctaccctgggatcagttgccgactggctgcaggccatcaacatggaacgttacagagacaacttcaccgctgctggctataccactccagaagctgtggtccatatgacacaagaggacatgacgaggatagggatctccaccgccgcacaccaggataagatcctcaacagcgcgcagggaatgttgtcccagatgcagcaaatgcaggacaggatggttcctgtctga

SEQ ID NO: 56 - protein, 986 aa, Danio rerio
  misc_feature (423)..(423): The 'Xaa' at location 423 stands for Pro.
MAALVFTATFALIIWIPTFVLTARVYPPNEVTLLDSRTVQGELKWVASPTEGGWEEVSIMDEKNTPIRTYQVCNVMEPSQNNWLRTDWIPRGGAQRVYIEIKFTLRDCNSLPGVMGTCKETFNLYYYESNNDKERYIRENQFTKIDTIAADESFTQVDIGDRIMKLNTEVRDVGILTRKGFYLAFQDVGACIALVSVRIFYKKCPLTVRNLAQFPDTTTGADTSSLVEVRGSCVDNSEEREVPKMYCGADGEWLVPIGNCLCNPGYEEHEGTCQACKIGNYRALATDGSCSKCPLHSYSVREGSTSCACDKGFFRSETDPASMPCTQPPSAPQHLISNVNETSVNLEWTAPASSGGRQDLAYNVICKRCSSDGQRCQPCGNGIHFSPQQLGLRTTRVSINDLQAHTNYTFEIWAVNGVSKQSXGPEQAVSVTVTTNQAAPSPVTTIQAKDITRHAVSLAWQQPERPNGVILEYEVKYYEKDQNERSYRIMKTSSRSAEIKGLSPLTSYVFHVRARTAAGYGEFSAPFEFMTNSVPSPIIGDGANSTVLLVSVIGSVILLLIFIGVFIISRRRSKYSKAKQDSDEERHLHPGVRIYVDPFTYEDPNQAVREFAKEIDASCIKIEKVIGIGEFGEVCSGRLKMPGKREICVAIKTLKAGYTDKQRRDFLSEASIMGQFDHPNIIRLEGVVTKCKPVMIITEYMENGSLDAFLRKNDGRFTVIQLVGILRGIASGMKYLSDMSYVHRDLAARNILVNSNLVCKVSDFGMSRVLEEDPDAAYTTRGGKIPIRWTAPEAITYRKFTSASDVWSYGIVMWEVMSYGERPYWDMSNQDVIKAIEEGYRLPPPMDCPVSLHQLMLDCWQKERAERPKFSQIVNMLDKLIRNPNSLKRTGGEIARPNTTLLEPSSPEFTSTLGSVADWLQAINMERYRDNFTAAGYTTPEAVVHMTQEDMTRIGISTAAHQDKILNSAQGMLSQMQQMQDRMVPV

SEQ ID NO: 57 - DNA, 2214 bp, Danio rerio
  CDS (1)..(2211)
atggacaatgagagcatgattgttctcctattgtccaagccagtggtcagaggcttcatggagagagggaggaaagcctgtaagatcggtaactacagagctctagccacagacggcagctgctctaagtgtcccctgcacagctactctgtgagagagggatctacttcctgtgcctgtgataaaggcttcttcaggtctgagacggaccctgcatctatgccctgcacacagcccccatctgctcctcagcacctcatttccaatgtgaacgagacttcggtaaatctggagtggacggctccagcatcctctggtggcagacaggaccttgcctataacgttatatgcaagcggtgcagctcggacggtcaacgctgtcagccctgcggcaatggcatccatttttcccctcagcagctgggtctacgcactacccgggtgtccataaatgacctgcaggctcacaccaactacaccttcgagatctgggcagtcaacggggtgtccaaacagagtcctggacccgaacaagcagtctctgtgactgttaccaccaaccaagcggctccctctccagttaccaccatccaggccaaggacatcacaagacatgctgtgtctttggcatggcaacagcccgagagacccaatggagtcattcttgagtacgaggtcaaatactatgagaaggatcaaaacgagcgcagttatcgcataatgaagacttcgtcccgaagcgctgagatcaaaggcctgagcccactcacctcctacgtgtttcatgtgcgtgcccgcaccgctgctggctacggagaattcagtgccccttttgagttcatgaccaactcagttccttctcccatcatcggggacggagctaactccaccgtgctcttggtgtctgtgatcggcagtgtgattttgttgctcatcttcatcggcgtcttcatcatcagccgcaggagaagcaaatacagcaaagccaagcaggattctgatgaggagaggcatttacacccaggagtccggatctatgtggaccccttcacatacgaggaccccaaccaagcagtccgtgaattcgctaaagaaatcgacgcctcctgcatcaagatcgaaaaggtcatcggcattggagaattcggagaggtgtgcagtggccgtctcaagatgcctggaaagcgtgagatctgtgtggccataaaaaccctaaaggcaggatacaccgacaagcaaaggcgggattttctgagcgaggccagcatcatgggccagtttgaccaccctaacatcatccgattggagggagttgtcactaaatgtaagccagttatgatcatcacagagtacatggagaacggatcacttgatgcttttcttaggaagaatgatggacggtttacagtgattcagctggtgggcatcctgcgaggcattgcttcaggaatgaaatatctctccgatatgagctatgtccatcgtgacttggcggctcgcaacattctggtcaacagcaacctggtgtgcaaagtgtccgactttggcatgtctcgagttttggaggaagacccagatgctgcttataccaccagaggaggcaagatacctattcgctggacggctcctgaagccattacttacaggaagttcacctccgcatctgacgtctggagctatggcatcgtcatgtgggaagtgatgtcatatggagagcggccatattgggacatgagcaaccaggatgtgataaaggccattgaggaaggctacaggctgcctcctcccatggactgtccagtttctttgcaccagttgatgttggattgctggcagaaagagcgcgcagaaaggccaaagttcagtcaaattgtcaacatgctggacaaactcatccgcaaccctaacagcctgaaaaggacaggaggagaaatagccagacccaacaccaccctcctggagcctagcagcccagaattcacgtctaccctgggatcagttgccgactggctgcaggccatcaacatggaacgttacagagacaacttcaccgctgctggctataccactccagaagctgtggtccatatgacacaagaggacatgacgaggatagggatctccaccgctgcacaccaggataagatcctcaacagcgcgcagggaatgttgtcccagatgcagcaaatgcaggacaggatggttcctgtctga

SEQ ID NO: 58 - protein, 737 aa, Danio rerio
MDNESMIVLLLSKPVVRGFMERGRKACKIGNYRALATDGSCSKCPLHSYSVREGSTSCACDKGFFRSETDPASMPCTQPPSAPQHLISNVNETSVNLEWTAPASSGGRQDLAYNVICKRCSSDGQRCQPCGNGIHFSPQQLGLRTTRVSINDLQAHTNYTFEIWAVNGVSKQSPGPEQAVSVTVTTNQAAPSPVTTIQAKDITRHAVSLAWQQPERPNGVILEYEVKYYEKDQNERSYRIMKTSSRSAEIKGLSPLTSYVFHVRARTAAGYGEFSAPFEFMTNSVPSPIIGDGANSTVLLVSVIGSVILLLIFIGVFIISRRRSKYSKAKQDSDEERHLHPGVRIYVDPFTYEDPNQAVREFAKEIDASCIKIEKVIGIGEFGEVCSGRLKMPGKREICVAIKTLKAGYTDKQRRDFLSEASIMGQFDHPNIIRLEGVVTKCKPVMIITEYMENGSLDAFLRKNDGRFTVIQLVGILRGIASGMKYLSDMSYVHRDLAARNILVNSNLVCKVSDFGMSRVLEEDPDAAYTTRGGKIPIRWTAPEAITYRKFTSASDVWSYGIVMWEVMSYGERPYWDMSNQDVIKAIEEGYRLPPPMDCPVSLHQLMLDCWQKERAERPKFSQIVNMLDKLIRNPNSLKRTGGEIARPNTTLLEPSSPEFTSTLGSVADWLQAINMERYRDNFTAAGYTTPEAVVHMTQEDMTRIGISTAAHQDKILNSAQGMLSQMQQMQDRMVPV

SEQ ID NO: 59 - DNA, 1404 bp, Mus musculus
  CDS (1)..(1401)
atgacagagatacctgcacctttgtcctacttccagaatgcccagatgtctgaggacagccactccagcagcgccatccggagccagaatgacagccaagaacggcagcagcagcatgacaggcagagacttgacaaccctgagccaatatctaatgggcggccccagagtaactcaagacaggtggtggaacaagatgaggaggaagacgaagagctgacattgaaatatggagccaagcatgtcatcatgctctttgtccccgtgaccctctgcatggtcgtcgtcgtggccaccatcaaatcagtcagcttctatacccggaaggacggtcagctaatctacaccccattcacagaagacactgagactgtaggccaaagagccctgcactcgatcctgaatgcggccatcatgatcagtgtcattgtcattatgaccatcctcctggtggtcctgtataaatacaggtgctacaaggtcatccacgcctggcttattatttcatctctgttgttgctgttctttttttcgttcatttacttaggggaagtatttaagacctacaatgtcgccgtggactacgttacagtagcactcctaatctggaattttggtgtggtcgggatgattgccatccactggaaaggcccccttcgactgcagcaggcgtatctcattatgatcagtgccctcatggccctggtatttatcaagtacctccccgaatggaccgcatggctcatcttggctgtgatttcagtatatgatttggtggctgttttatgtcccaaaggcccacttcgtatgctggttgaaacagctcaggaaagaaatgagactctctttccagctcttatctattcctcaacaatggtgtggttggtgaatatggctgaaggagacccagaagcccaaaggagggtacccaagaaccccaagtataacacacaaagagcggagagagagacacaggacagtggttctgggaacgatgatggtggcttcagtgaggagtgggaggcccaaagagacagtcacctggggcctcatcgctccactcccgagtcaagagctgctgtccaggaactttctgggagcattctaacgagtgaagacccggaggaaagaggagtaaaacttggactgggagatttcattttctacagtgttctggttggtaaggcctcagcaaccgccagtggagactggaacacaaccatagcctgctttgtagccatactgatcggcctgtgccttacattactcctgctcgccattttcaagaaagcgttgccagccctccccatctccatcaccttcgggctcgtgttctacttcgccacggattaccttgtgcagcccttcatggaccaacttgcattccatcagttttatatctag

SEQ ID NO: 60 - protein, 467 aa, Mus musculus
MTEIPAPLSYFQNAQMSEDSHSSSAIRSQNDSQERQQQHDRQRLDNPEPISNGRPQSNSRQVVEQDEEEDEELTLKYGAKHVIMLFVPVTLCMVVVVATIKSVSFYTRKDGQLIYTPFTEDTETVGQRALHSILNAAIMISVIVIMTILLVVLYKYRCYKVIHAWLIISSLLLLFFFSFIYLGEVFKTYNVAVDYVTVALLIWNFGVVGMIAIHWKGPLRLQQAYLIMISALMALVFIKYLPEWTAWLILAVISVYDLVAVLCPKGPLRMLVETAQERNETLFPALIYSSTMVWLVNMAEGDPEAQRRVPKNPKYNTQRAERETQDSGSGNDDGGFSEEWEAQRDSHLGPHRSTPESRAAVQELSGSILTSEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 61 - DNA, 1407 bp, Rattus norvegicus
  CDS (1)..(1404)
atgacagagatacctgcacctttgtcctacttccagaatgcacagatgtctgaggacagccactccagcagcgtccgtagccagaatgacaatcaagaacggcagcagcatcatgacagacagagacttgacaaccctgagtcgatatctaatggccgaccccagagtaactttaccaggcaggtgatagagcaagatgaggaggaagacgaagagctgacattgaaatatggagccaagcacgtcatcatgctctttgttcctgtgaccctctgcatggtcgttgtggtggccactatcaagtcagtcagcttctacacccggaaggatgggcagctaatctataccccattcacagaagacaccgagactgtaggccagagagccctgcactcgatcttgaatgccgccatcatgatcagtgtcatcgtcgttatgaccatcctcctggtggtcctgtataagtacaggtgctacaaggtcatccatgcctggcttattgtttcatctctgttgttgctgttctttttttcattcatttacttaggggaagtattcaagacctacaatgtcgccgtggactatattacggttgcactcctgatctggaattttggtgtggtcgggatgattgccattcactggaaaggcccactccgactgcagcaggcgtatctcattatgatcagtgccctcatgtccctggtatttatcaagtacctccctgaatggaccgcatggctcatcttggctgtgatttcagtatatgatttggtggctgttctgtgccccaaaggtccacttcgtatgctggtcgaaacagctcaggaaagaaatgagactctctttccagctcttatctattcctcaaccatggtgtggttggtgaatatggctgaaggagacccagaagcccaaaggagggtacccaaaaaccccaagtatagcacacaaggaacagagagggaagagacacaggacactggcactgggagcgatgatggtggcttcagtgaggagtgggaggcccaaagagacagtcacctggggcctcatcgctccactcctgagtcaagagctgctgtccaggaactttctgggagcatcctcactagtgaagacccggaggaaagaggagtaaggcttgggctgggagatttcattttctacagtgttctggttggtaaggcctcagcgaccgccagtggggactggaacacaaccatagcctgctttgtagccatattgatcggcctgtgccttacgttactcctgctcgccattttcaagaaagcgttgccggcccttcccatctccatcaccttcgggctcattttctactttgccacggattatctcgtgcagcccttcatggaccaacttgcattccatcaattttatatctag

SEQ ID NO: 62 - protein, 468 aa, Rattus norvegicus
MTEIPAPLSYFQNAQMSEDSHSSSVRSQNDNQERQQHHDRQRLDNPESISNGRPQSNFTRQVIEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIVSSLLLLFFFSFIYLGEVFKTYNVAVDYITVALLIWNFGVVGMIAIHWKGPLRLQQAYLIMISALMSLVFIKYLPEWTAWLILAVISVYDLVAVLCPKGPLRMLVETAQERNETLFPALIYSSTMVWLVNMAEGDPEAQRRVPKNPKYSTQGTEREETQDTGTGSDDGGFSEEWEAQRDSHLGPHRSTPESRAAVQELSGSILTSEDPEERGVRLGLGDFIFYSVLVGKASATASGDWNTTIACFVAILIGLCLTLLLLAIFKKALPALPISITFGLIFYFATDYLVQPFMDQLAFHQFYI

SEQ ID NO: 63 - DNA, 1404 bp, Homo sapiens
  CDS (1)..(1401)
atgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctag

SEQ ID NO: 64 - protein, 467 aa, Homo sapiens
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAESTERESQDTVAENDDGGFSEEWEAQRDSHLGPHRSTPESRAAVQELSSSILAGEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 65 - DNA, 1347 bp, Mus musculus
  CDS (1)..(1344)
atgctcgcattcatggcctctgacagcgaggaagaggtgtgtgatgagcggacgtccttgatgtcagccgagagccccacatctcgctcctgccaggaaggcaggccaggcccggaggatggagagagcactgcccagtggaggactcaggagagcgaagaagactgtgaagaggacccggaccgctacgcatgcagtggggctcctgggcgaccgtcgggcctggaggaagagctgaccctcaagtatggggcgaaacgtgtgatcatgctattcgtgcctgtcacgctgtgtatgatcgtggtggtggccactatcaagtctgtgcgtttctacactgagaagaacgggcagctcatctacacgcccttcacggaggacacgccctcggtgggccagcggctcctcaactccgtgcttaacaccctcatcatgatcagcgtcatcgtagtcatgaccatcttcctcgtggtactctacaagtatcgatgctacaagttcatccatggctggctgatcatgtcctccctgatgctcctcttcttgttcacctacatctacctcggggaagtgctcaagacctacaatgtggccatggactatcccacactcttcctggctgtctggaacttcggggcagtgggcatggtgtgcatccactggaaggggcctctagcgctgcagcaggcttaccttattgtgatcagcgcactcatggccctggtgttcatcaagtacctgccggagtggtctgcctgggtcatcttgggtgccatctctgtgtacgatctcgtggccgtgctgtgccccaaagggccactgaggatgctggtggaaactgcccaggagagaaatgagcccatatttcctgccctgatatactcatctgccatggtgtggacggtgggcatggcaaagctggacccctcctctcaaggagcgctgcagctcccctatgacccagagatggaagaagactcctacgacagttttggagaaccctcataccctgaagccttcgaagcccccctgcctggctacccaggggaggagctggaggaggaggaggaaaggggcgtgaagctcggcctgggagacttcatcttctacagcgtcctggtgggcaaggctgcagccactggcaacggagactggaacactacgctggcctgttttatcgccatcctcattggcttgtgtctcaccctcctgctgcttgctgtgttcaagaaggctctgcccgccctccccatctccatcacctttggactcatcttctacttctccacagacaacctggtgcgccctttcatggacactctggcctcccaccagctctacatctga

SEQ ID NO: 66 - protein, 448 aa, Mus musculus
MLAFMASDSEEEVCDERTSLMSAESPTSRSCQEGRPGPEDGESTAQWRTQESEEDCEEDPDRYACSGAPGRPSGLEEELTLKYGAKRVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLFLAVWNFGAVGMVCIHWKGPLALQQAYLIVISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEAFEAPLPGYPGEELEEEEERGVKLGLGDFIFYSVLVGKAAATGNGDWNTTLACFIAILIGLCLTLLLLAVFKKALPALPISITFGLIFYFSTDNLVRPFMDTLASHQLYI

SEQ ID NO: 67 - DNA, 1347 bp, Rattus norvegicus
  CDS (1)..(1344)
atgctcacattcatggcctctgatagcgaggaagaggtgtgcgatgagcggacgtccttgatgtcagccgagagccctacatcacgttcctgccaggacagcaggccaggcccagaggatggagagaacactgcccagtggaggagccaggagaacgaggacgactgtgaggaggacccggaccactatgcctgcagtggggttcctgggcgaccatcgggcctggaggaggagctgaccctcaagtatggggcgaagcacgtgatcatgctgttcgtgcctgtcacgctgtgcatgattgtggtggtggccaccatcaagtccgtgcgtttctacacggagaagaacgggcagctcatctacacgcccttcaccgaggacacaccctctgtgggccagcggctcctcaactccgtgctgaacactctgatcatgatcagcgtcattgtggtcatgactatcttcctagtggtactctacaaatatcgctgttacaagttcatccatggctggctgatcatgtcctccctgatgctcctcttcttgttcacctacatctacctcggggaagtgttcaagacctacaatgtggccatggactaccccacactgttcctggctgtctggaacttcggggcagtgggcatggtgtgcatccactggaagggtcccctggtgctccagcaggcttacctcattgtgatcagcgcactcatggccctggtgttcatcaagtacctgccggagtggtccgcttgggtcatcttgggcgccatctctgtgtacgatctcgtggctgtgctgtgccccaaagggccactgaggatgctggtggaaactgcccaggaaagaaacgagcccatatttcctgccctcatatactcatctgccatggtgtggacggtaggcatggcgaagctggacccctcctctcagggagcactgcagctcccttacgatccagagatggaagaagactcctatgacagttttggggaaccctcataccctgaagccttcgaagctccccagcctggctacccaggggaagagccggaggaggaggaggaaaggggtgtaaagcttggtctgggagacttcatcttctacagcgttctggtgggcaaggcagcagccacaggcaacggagactggagcacgacgctggcctgctttatcgccatcctcattggcttgtgtctcaccctcctgctgctcgccgtgttcaagaaggccctgcccgccctccccatctccatcaccttcgggctcatcttttacttctccacagacaacctggtgcgtcctttcatggacacgttggcctcccaccagctctacatctga

SEQ ID NO: 68 - protein, 448 aa, Rattus norvegicus
MLTFMASDSEEEVCDERTSLMSAESPTSRSCQDSRPGPEDGENTAQWRSQENEDDCEEDPDHYACSGVPGRPSGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVFKTYNVAMDYPTLFLAVWNFGAVGMVCIHWKGPLVLQQAYLIVISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEAFEAPQPGYPGEEPEEEEERGVKLGLGDFIFYSVLVGKAAATGNGDWSTTLACFIAILIGLCLTLLLLAVFKKALPALPISITFGLIFYFSTDNLVRPFMDTLASHQLYI

SEQ ID NO: 69 - DNA, 1347 bp, Homo sapiens
  CDS (1)..(1344)
atgctcacattcatggcctctgacagcgaggaagaagtgtgtgatgagcggacgtccctaatgtcggctgagagccccacgccgcgctcctgccaggagggcaggcagggcccagaggatggagagaacactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctga

SEQ ID NO: 70 - protein, 448 aa, Homo sapiens
MLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFSTDNLVRPFMDTLASHQLYI

SEQ ID NO: 71 - DNA, 2127 bp, Mus musculus
  CDS (1)..(2124)
atggctacgactaggggcggctctgggcctgacccaggaagtcggggtcttcttcttctgtctttttccgtggtactggcaggattgtgtgggggaaactcagtggagaggaaaatctacattcccttaaataaaacagctccttgtgtccgcctgctcaacgccactcatcagattggctgccagtcttcaattagtggggatacaggggttatccacgtagtggagaaagaagaagacctgaagtgggtgttgaccgatggccccaaccccccttacatggttctgctggagggcaagctcttcaccagagatgtaatggagaagctgaagggaacaaccagtagaatcgctggtcttgccgtgactctagccaagcccaactcaacttcaagcttctctcctagtgtgcagtgcccaaatgatgggtttggtatttactccaactcctacgggccagagtttgctcactgcaagaaaacactgtggaatgaactgggcaacggcttggcttatgaagactttagtttccccatctttcttcttgaagatgagaacgaaaccaaggtcatcaagcagtgctatcaagatcacaacctgggtcagaatggctctgcaccaagcttcccattgtgtgctatgcagctcttctcacacatgcacgccgtcatcagcactgccacctgcatgcggcgcagcttcatccagagcaccttcagcatcaacccagaaatcgtctgtgaccccttatctgactacaacgtatggagcatgcttaagcctataaatacatctgtgggactagaacctgacgtcagggttgtggttgcggccacacggctggatagccggtcctttttctggaatgtggccccaggggctgaaagtgctgtagcctcctttgtcactcagctggctgcagctgaagctttgcacaaggcacctgatgtgaccactctatcccgaaatgtgatgtttgtcttcttccagggggaaacttttgactacattggcagctcacggatggtctatgatatggagaacggcaagtttcccgtgcggctcgagaacatcgactccttcgtggagctgggacaggtggccctaagaacttcactagatctctggatgcacacagatcccatgtctcagaaaaatgagtctgtgaaaaaccaggtggaggatcttctggccactctggagaagagcggtgctggtgtccctgaagttgtcctgaggagactggcccagtcccaggcccttccaccttcatctctacaacgatttcttcgggctcgaaacatctctggcgtggtcctggctgaccactctggctccttccacaatcggtattaccagagcatttatgacacggctgagaacattaatgtgacctatcctgagtggcagagcccagaagaggacctcaactttgtgacagacactgccaaggcactggcgaatgtggccacagtgctggcgcgtgcactgtatgagcttgcaggaggaaccaacttcagcagctccatccaggctgatccccagacagttacacgtctgctctatgggttcctggttaaagctaacaactcatggtttcagtcgatcctgaaacatgacctaaggtcctatttggatgacaggcctcttcaacactacatcgccgtctccagccctaccaacacgacttacgttgtgcagtacgccttggcaaacctgactggcaaggcgaccaacctcacccgagagcagtgccaggatccaagtaaagtcccaaatgagagcaaggatttatatgaatactcgtgggtacaaggcccttggaattccaacaggacagagaggctcccacagtgtgtgcgctccacagtgcgactggccagggccttgtcccctgcctttgaactgagtcagtggagctccacagaatactctacgtgggcggagagccgctggaaagacatccaagctcggatattcctaattgccagcaaagagcttgagttcatcacgctgatcgtgggcttcagcatccttatcttctctctcatcgtcacctactgcatcaatgccaaagccgacgtcctttttgttgctccccgagagccaggagctgtgtcttactga

SEQ ID NO: 72 - protein, 708 aa, Mus musculus
MATTRGGSGPDPGSRGLLLLSFSVVLAGLCGGNSVERKIYIPLNKTAPCVRLLNATHQIGCQSSISGDTGVIHVVEKEEDLKWVLTDGPNPPYMVLLEGKLFTRDVMEKLKGTTSRIAGLAVTLAKPNSTSSFSPSVQCPNDGFGIYSNSYGPEFAHCKKTLWNELGNGLAYEDFSFPIFLLEDENETKVIKQCYQDHNLGQNGSAPSFPLCAMQLFSHMHAVISTATCMRRSFIQSTFSINPEIVCDPLSDYNVWSMLKPINTSVGLEPDVRVVVAATRLDSRSFFWNVAPGAESAVASFVTQLAAAEALHKAPDVTTLSRNVMFVFFQGETFDYIGSSRMVYDMENGKFPVRLENIDSFVELGQVALRTSLDLWMHTDPMSQKNESVKNQVEDLLATLEKSGAGVPEVVLRRLAQSQALPPSSLQRFLRARNISGVVLADHSGSFHNRYYQSIYDTAENINVTYPEWQSPEEDLNFVTDTAKALANVATVLARALYELAGGTNFSSSIQADPQTVTRLLYGFLVKANNSWFQSILKHDLRSYLDDRPLQHYIAVSSPTNTTYVVQYALANLTGKATNLTREQCQDPSKVPNESKDLYEYSWVQGPWNSNRTERLPQCVRSTVRLARALSPAFELSQWSSTEYSTWAESRWKDIQARIFLIASKELEFITLIVGFSILIFSLIVTYCINAKADVLFVAPREPGAVSY

SEQ ID NO: 73 - DNA, 2127 bp, Rattus norvegicus
  CDS (1)..(2124)
atggctacggctaggggcggctctgggcctgacccaggaagtcggggtctccttcttctgtctttttccgtggtactagcaggattgtgtgggggaaactcagtggagaggaagatctacattcccttaaataaaacagctccttgtgtccgcctgctcaatgccactcatcagattggctgccagtcttcaattagtggggatacaggggttatccacgtagtggagaaagaagacgacctgaaatgggtattgacggatggccccaaccccccttacatggttctgctggagggcaagctctttaccagagatataatggaaaagctgaagggggaaaccagtagaatcgctggtcttgccgtgactctagccaagcccaattcaacgtcaagcttctctcctagcgtgcagtgcccaaatgatgggtttggtatttactccaactcctatgggccagagtttgctcactgcaaaaaaacattgtggaatgaactgggcaatggcttggcttatgacgacttcagtttccccatctttcttcttgaagatgagaacgaaaccaaggtcatcaagcagtgctatcaagatcacaacctgggtcagaatggctctgcaccgagcttcccactgtgtgctatgcagctcttctcacacatgcacgccgtcatcagcaccgccacctgcatgcgacgcagcttcatccagagcaccttcagcatcaacccagaaatcgtctgtgaccccttatccgactacaacgtatggagcatgcttaagcctataaatacgtctgggggattagaacctgatgtcagggttgtggttgcagccacacggctggatagccggtccttcttctggaatgtggccccaggggcagaaagtgccgttgcctcctttgtcactcagctggccgcagctgaagctttgcacaaggcacctgatgtgaccaccctaccccgaaatgtgatgtttgtcttcttccagggggaaacttttgactacattggcagctcaaggatggtctatgacatggagaacggcaagtttcctgtgcggctagagaacattgactcctttgtggagctggggcaggtggccctaaggacgtcactagaactctggatgcacacagatcctatgtctcagaaaaatgaatctgtgaagaaccaggtggaggatcttctggtcactctggagcagagtggtgctgatacccctcaagttgtcctgagcagactagtccagtcccaggcccttccaccatcatctctacaacgatttcttcgggctcgaaacatctctggtgtggtcttggctgaccactctggttccttccacaatcggtattaccagagcatttatgacactgctgagaacattaacgtgacctatcctgagtcgcagagcccagaagaggacctcaactttgtaacagacactgccaaggcactggcagatgttgccacagtgctggcacgagctttgtacaagcttgcaggaggaaccaacttcaacaactccattcaggctgatccccagacagttacacgtctgctctatgggttcctggtcagagctaacaactcatggtttcagtctatcctcagacatgatctgaggtcctatttggatgatgggcctcttcaacactacatcgctgtctccagccctaccaacacgacttacgttgtgcagtatgccttggcaaacctgactggcaaggtgaccaacctcacccaagagcagtgccaggatccaagtaaagtcccaaatgaaagcaaggatttgtatgaatactcgtgggtacaaggcccttggaattccaacaagacagagcggctcccacggtgtgtgcgctccacagtacgactggctagggccttgtcccccgcctttgagctgagtcagtggagctccacagaatactctacgtgggccgagagccgctggaaagatatccaagctcggatattcctcattgccagcaaagaacttgagttcatcacgctgatcgtgggcttcagcatcctcgtcttttctctcatcgtcacttattgtatcaacgccaaggccgatgtccttttcgttgctccccgagagccaggagctgtgtcttactga

SEQ ID NO: 74 - protein, 708 aa, Rattus norvegicus
MATARGGSGPDPGSRGLLLLSFSVVLAGLCGGNSVERKIYIPLNKTAPCVRLLNATHQIGCQSSISGDTGVIHVVEKEDDLKWVLTDGPNPPYMVLLEGKLFTRDIMEKLKGETSRIAGLAVTLAKPNSTSSFSPSVQCPNDGFGIYSNSYGPEFAHCKKTLWNELGNGLAYDDFSFPIFLLEDENETKVIKQCYQDHNLGQNGSAPSFPLCAMQLFSHMHAVISTATCMRRSFIQSTFSINPEIVCDPLSDYNVWSMLKPINTSGGLEPDVRVVVAATRLDSRSFFWNVAPGAESAVASFVTQLAAAEALHKAPDVTTLPRNVMFVFFQGETFDYIGSSRMVYDMENGKFPVRLENIDSFVELGQVALRTSLELWMHTDPMSQKNESVKNQVEDLLVTLEQSGADTPQVVLSRLVQSQALPPSSLQRFLRARNISGVVLADHSGSFHNRYYQSIYDTAENINVTYPESQSPEEDLNFVTDTAKALADVATVLARALYKLAGGTNFNNSIQADPQTVTRLLYGFLVRANNSWFQSILRHDLRSYLDDGPLQHYIAVSSPTNTTYVVQYALANLTGKVTNLTQEQCQDPSKVPNESKDLYEYSWVQGPWNSNKTERLPRCVRSTVRLARALSPAFELSQWSSTEYSTWAESRWKDIQARIFLIASKELEFITLIVGFSILVFSLIVTYCINAKADVLFVAPREPGAVSY

SEQ ID NO: 75 - DNA, 2130 bp, Homo sapiens
  CDS (1)..(2127)
atggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactga

SEQ ID NO: 76 - protein, 709 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 77 - DNA, 744 bp, Mus musculus
  CDS (1)..(741)
atgggggctgctgtgtttttcggatgcaccttcgtcgcgttcggcccagccttctcccttttcctgatcactgtagctggagacccacttcgggttatcatcctggtggcgggagcctttttctggctggtctccctgctcttggcttctgtggtctggttcatcttggtccatgtgacagaccgatcagatgcacggctccagtatggcctcctgatttttggtgctgctgtctctgtccttctacaggaagtgttccgttttgcttactacaagctccttaagaaggcagatgagggcttagcatcactgagtgaggacggaagatcacccatctccatccgacagatggcctatgtttctggtctgtccttcggtatcatcagtggtgtcttctctgttatcaatattttggctgatgcacttgggccaggtgtggttgggatccatggagactcaccctattacttcctgacttcagcctttctgacagcagccattatcctgctccacaccttttggggagttgtgttctttgatgcctgtgagaggagacggtactgggctttgggcctggtagttgggagtcaccttctgacatcgggactgacattcctgaacccctggtatgaggctagcctgctgcccatctatgcagtcaccgtttccatggggctctgggcgttcatcacagccggaggctccctccgaagtatccagcgcagcctttcgtgtaaggactga

SEQ ID NO: 78 - protein, 247 aa, Mus musculus
MGAAVFFGCTFVAFGPAFSLFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLSCKD

SEQ ID NO: 79 - DNA, 744 bp, Rattus norvegicus
  CDS (1)..(741)
atgggggctgctgtgtttttcggatgcaccttcgtcgcgttcggcccagccttcgcccttttcctgattactgtagccggagaccctcttcgggttatcatcctggtggcgggagcctttttctggctggtttccctgctcttggcctctgtggtctggttcatcttggtccatgtgacagaccgatcagatgcacggctccagtatggcctcctgatttttggtgctgctgtctctgtccttctacaggaagtgttccgttttgcctactacaagctccttaagaaggcagatgagggcttagcatcactaagtgaggacggaagatcgcccatctccatccgacagatggcctatgtttctggtctgtccttcggtatcatcagtggtgtcttctctgttatcaatattttggctgatgcacttgggccaggtgtggttgggatccatggagactcaccctattacttcctgacttcagcttttctgacagcagccattatcctgctccataccttttggggagttgtgttctttgatgcctgtgagaggagacggtactgggctttgggcctggtagttgggagtcaccttctgacttcaggactgacattcctgaacccctggtatgaggccagcctgctgcccatctatgcagtcaccgtttccatggggctctgggcattcgtcacagccggaggctccctccggagtatccagcgcagcctttcgtgtaaggactga

SEQ ID NO: 80 - protein, 247 aa, Rattus norvegicus
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFVTAGGSLRSIQRSLSCKD

SEQ ID NO: 81 - DNA, 744 bp, Homo sapiens
  CDS (1)..(741)
atgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactga

SEQ ID NO: 82 - protein, 247 aa, Homo sapiens
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLCKD

SEQ ID NO: 83 - DNA, 306 bp, Mus musculus
  CDS (1)..(303)
atgaacttggagcgggtatccaatgaggagaagttgaacctgtgccggaagtactatcttggtggatttgcgttcctgccttttctttggttagtcaacattttctggttcttcagagaggcgttcctcgccccagcctacacagagcagagccaaatcaaaggctatgtttggcgctcagctgtgggcttcctcttctgggtgatcattctcgccacctggatcaccatcttccagatctaccggccccgctggggcgctcttggggactacctctccttcaccattcccctgggcactccctaa

SEQ ID NO: 84 - protein, 101 aa, Mus musculus
MNLERVSNEEKLNLCRKYYLGGFAFLPFLWLVNIFWFFREAFLAPAYTEQSQIKGYVWRSAVGFLFWVIILATWITIFQIYRPRWGALGDYLSFTIPLGTP

SEQ ID NO: 85 - DNA, 306 bp, Rattus norvegicus
  CDS (1)..(303)
atgaacttagagcgggtgtccaatgaggagaagttgaacctgtgccggaagtactatcttggtggatttgcatttctgccttttctttggttggtcaacattttctggttcttcaaagaggccttcttcgctccagcctacacagagcagagccaaatcaaaggctatgtttggcgctcagctgtgggcttcctcttctgggtgattgttctcaccacctggatcaccatcttccagatctaccggccccgctggggtgctcttggggactacctctccttcaccattcccctgggcactccctga

SEQ ID NO: 86 - protein, 101 aa, Rattus norvegicus
MNLERVSNEEKLNLCRKYYLGGFAFLPFLWLVNIFWFFKEAFFAPAYTEQSQIKGYVWRSAVGFLFWVIVLTTWITIFQIYRPRWGALGDYLSFTIPLGTP

SEQ ID NO: 87 - DNA, 306 bp, Homo sapiens
  CDS (1)..(303)
atgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctgtgggcttcctcttctgggtgatagtgctcacctcctggatcaccatcttccagatctaccggccccgctggggtgcccttggggactacctctccttcaccatacccctgggcaccccctga

SEQ ID NO: 88 - protein, 101 aa, Homo sapiens
MNLERVSNEEKLNLCRKYYLGGFAFLPFLWLVNIFWFFREAFLVPAYTEQSQIKGYVWRSAVGFLFWVIVLTSWITIFQIYRPRWGALGDYLSFTIPLGTP

SEQ ID NO: 89 - DNA, 1272 bp, Rattus norvegicus
  CDS (1)..(1269)
attgcggcatttgtgatcagccgtagacggagtaagtacagccaagcaaagcaagaagcagatgaagagaagcatttgaatcaaggtgttagaacatacgtggatccctttacatatgaagaccccaaccaggcagttcgagaatttgccaaagaaatcgatgcctcctgcattaaaatcgaaaaggtcattggagttggcgaatttggagaagtctgcagtgggcgtctcaaagtgcccggcaagagagagatctgtgtggccatcaagactctgaaagctggttatactgacaagcagaggagagacttcctgagcgaggccagcatcatgggacagtttgaccacccaaacataatccacctggaaggcgttgtcaccaaatgtaaaccagtaatgatcatcacggagtacatggagaacggctccttggacgctttcctcaggaagaatgatggccgatttacagtcattcagctggtgggcatgctccgaggcattggctcggggatgaagtacttatctgatatgagctatgtgcatcgagacctggctgccaggaacattctggtaaacagcaacttggtctgcaaggtgtctgatttcggcatgtccagggtgcttgaggatgacccggaagcagcctatactaccaggggcggcaagattcccatccggtggactgcaccagaagcaattgcgtatcgtaaatttacctcagccagtgacgtctggagctacggaatcgttatgtgggaagtgatgtcatatggagagaggccgtactgggatatgtccaatcaagatgtgatcaaagccatcgaggaagggtaccggctacccccgccaatggactgccccattgccctccatcagttaatgctggactgttggcagaaagagagaagcgacaggcctaaatttgggcagatcgtcaacatgttggacaaactcatccgcaaccccaacagcctgaagaggacagggccagagagttccagaccaaacacagccttgttagatcccagctcccctgaattctccgccgtagtatcagtgggtgactggctgcaggccatcaaaatggaccggtataaggacaacttcacagccgccgggtacacgacactagaagctgtggttcacatgagccaggatgacctggcgcgaattggcatcaccgcaatcacgcaccagaataagattttgagcagcgtccaggcgatgcgaacccagatgcagcagatgcatggcaggatggttcctgtctga

SEQ ID NO: 90 - protein, 423 aa, Rattus norvegicus
IAAFVISRRRSKYSQAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGPESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 91 - DNA, 1251 bp, Rattus norvegicus
  CDS (1)..(1248)
cgtagacggagtaagtacagccaagcaaagcaagaagcagatgaagagaagcatttgaatcaaggtgttagaacatacgtggatccctttacatatgaagaccccaaccaggcagttcgagaatttgccaaagaaatcgatgcctcctgcattaaaatcgaaaaggtcattggagttggcgaatttggagaagtctgcagtgggcgtctcaaagtgcccggcaagagagagatctgtgtggccatcaagactctgaaagctggttatactgacaagcagaggagagacttcctgagcgaggccagcatcatgggacagtttgaccacccaaacataatccacctggaaggcgttgtcaccaaatgtaaaccagtaatgatcatcacggagtacatggagaacggctccttggacgctttcctcaggaagaatgatggccgatttacagtcattcagctggtgggcatgctccgaggcattggctcggggatgaagtacttatctgatatgagctatgtgcatcgagacctggctgccaggaacattctggtaaacagcaacttggtctgcaaggtgtctgatttcggcatgtccagggtgcttgaggatgacccggaagcagcctatactaccaggggcggcaagattcccatccggtggactgcaccagaagcaattgcgtatcgtaaatttacctcagccagtgacgtctggagctacggaatcgttatgtgggaagtgatgtcatatggagagaggccgtactgggatatgtccaatcaagatgtgatcaaagccatcgaggaagggtaccggctacccccgccaatggactgccccattgccctccatcagttaatgctggactgttggcagaaagagagaagcgacaggcctaaatttgggcagatcgtcaacatgttggacaaactcatccgcaaccccaacagcctgaagaggacagggccagagagttccagaccaaacacagccttgttagatcccagctcccctgaattctccgccgtagtatcagtgggtgactggctgcaggccatcaaaatggaccggtataaggacaacttcacagccgccgggtacacgacactagaagctgtggttcacatgagccaggatgacctggcgcgaattggcatcaccgcaatcacgcaccagaataagattttgagcagcgtccaggcgatgcgaacccagatgcagcagatgcatggcaggatggttcctgtctga

SEQ ID NO: 92 - protein, 416 aa, Rattus norvegicus
RRRSKYSQAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGPESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 93 - DNA, 1296 bp, Rattus norvegicus
  CDS (1)..(1293)
atggactacccatacgacgtcccagactacgctacgcgtgtcgagcgtagacggagtaagtacagccaagcaaagcaagaagcagatgaagagaagcatttgaatcaaggtgttagaacatacgtggatccctttacatatgaagaccccaaccaggcagttcgagaatttgccaaagaaatcgatgcctcctgcattaaaatcgaaaaggtcattggagttggcgaatttggagaagtctgcagtgggcgtctcaaagtgcccggcaagagagagatctgtgtggccatcaagactctgaaagctggttatactgacaagcagaggagagacttcctgagcgaggccagcatcatgggacagtttgaccacccaaacataatccacctggaaggcgttgtcaccaaatgtaaaccagtaatgatcatcacggagtacatggagaacggctccttggacgctttcctcaggaagaatgatggccgatttacagtcattcagctggtgggcatgctccgaggcattggctcggggatgaagtatttatctgatatgagctatgtgcatcgagacctggctgccaggaacattctggtaaatagcaacttggtctgcaaggtgtctgatttcggcatgtccagggtgcttgaggatgacccggaagcagcctatactaccaggggcggcaagattcccatccggtggactgcaccagaagcaattgcgtatcgtaaatttacctcagccagtgacgtctggagctacggaatcgttatgtgggaagtgatgtcatatggagagaggccgtactgggatatgtccaatcaagatgtgatcaaagccatcgaggaagggtaccggctacccccgccaatggactgccccattgccctccatcagttaatgctggactgttggcagaaagagagaagcgacaggcctaaatttgggcagatcgtcaacatgttggacaaactcatccgcaaccccaacagcctgaagaggacagggccagagagttccagaccaaacacagccttgttagatcccagctcccctgaattctccgccgtagtatcagtgggtgactggctgcaggccatcaaaatggaccggtataaggacaacttcacagccgccgggtacacgacactagaagctgtggttcacatgagccaggatgacctggcgcgaattggcatcaccgcaatcacgcaccagaataagattttgagcagcgtccaggcgatgcgaacccagatgcagcagatgcatggcaggatggttcctgtctga

SEQ ID NO: 94 - protein, 431 aa, Rattus norvegicus
MDYPYDVPDYATRVERRRSKYSQAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGPESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 95 - DNA, 1251 bp, Homo sapiens
  CDS (1)..(1248)
cggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 96 - protein, 416 aa, Homo sapiens
RRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 97 - DNA, 1140 bp, Homo sapiens
  CDS (1)..(1137)
cggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggtcattaaaatggaccggtataaggataacttcacagctgctggttataccacactagaggctgtggtgcacgtgaaccaggagtaa

SEQ ID NO: 98 - protein, 379 aa, Homo sapiens
RRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQVIKMDRYKDNFTAAGYTTLEAVVHVNQE

SEQ ID NO: 99 - DNA, 3000 bp, Homo sapiens
  CDS (1)..(2997)
atggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtcgcggccgcagactacccatacgacgtcccagactacgcttag

SEQ ID NO: 100 - protein, 999 aa, Homo sapiens
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPVAAADYPYDVPDYA

SEQ ID NO: 101 - DNA, 1251 bp, Mus musculus
  CDS (1)..(1248)
cgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaattgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagtgacaggcctaaatttgggcagatcgtcaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctga

SEQ ID NO: 102 - protein, 416 aa, Mus musculus
RRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 103 - DNA, 1251 bp, Mus musculus; identical to SEQ ID NO: 101
  CDS (1)..(1248)

SEQ ID NO: 104 - protein, 416 aa, Mus musculus; identical to SEQ ID NO: 102

SEQ ID NO: 105 - DNA, 1251 bp, Mus musculus; identical to SEQ ID NO: 101
  CDS (1)..(1248)

SEQ ID NO: 106 - protein, 416 aa, Mus musculus; identical to SEQ ID NO: 102

SEQ ID NO: 107 - DNA, 1251 bp, Mus musculus
  CDS (1)..(1248)
cgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaatcgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagcgacaggcctaaatttgggcagatcgttaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctga

SEQ ID NO: 108 - protein, 416 aa, Mus musculus; identical to SEQ ID NO: 102

SEQ ID NO: 109 - DNA, 1251 bp, Monodelphis domestica
  CDS (1)..(1248)
cggagacggagtaaatacagtaaggcaaagcaggaagcagatgaagagaaacatttgaatcaaggtgtgagaacctatgttgacccttttacatatgaagatcccaaccaagctgttcgagagtttgccaaagaaattgatgcctcctgcattaagatagaaaaagttataggagtgggtgaatttggtgaagtgtgcagtgggcgactcaaagtacctgggaagagagagatctgtgtggctattaagactcttaaagctgggtatacagacaaacagaggagggatttcctaagtgaagccagcatcatgggacagtttgaccacccaaatatcatccacttagaaggcgtagttaccaaatgtaaacctgtaatgatcataaccgagtacatggagaatggctccttggatgcattcctgaggaagaatgatggaagatttacagtgattcagttggttgggatgcttcgtggcattggttctgggatgaaatacctctctgatatgagctatgtgcatagagatctagctgcccggaacatcttggtcaatagcaacttggtctgcaaagtatctgactttggcatgtctcgtgttcttgaagatgatcctgaagcagcttacacaaccaggggtggcaagattcccatccggtggactgcaccagaagcgattgcttatcgtaaattcacatccgcgagtgatgtatggagctatggaattgtgatgtgggaagtgatgtcgtatggagagcggccttactgggatatgtccaaccaggatgttataaaagccattgaagaaggctaccggctacctccaccaatggactgccccatcgctctccaccagctgatgctagactgctggcagaaggaaagaagtgacagacctaaatttggacagattgtcaacatgttggacaaactcattcgcaaccccaacagcttgaagaggacgggtactgagagctccaggcccaatactgctctgttggatcctagctctcccgagttctctgctgtggtatctgtaggtgattggcttcaggccattaaaatggaccggtataaggacaacttcacagctgccggttacaccaccctcgaggctgtggtgcacatgaaccaggacgacctggcgagaatcggtatcacggccgtcacgcaccagaataagatcttgaacagcgtccaggcaatgcggacccaaatgcaacagatgcatggcaggatggttcctgtctga

SEQ ID NO: 110 - protein, 416 aa, Monodelphis domestica
RRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHMNQDDLARIGITAVTHQNKILNSVQAMRTQMQQMHGRMVPV

SEQ ID NO: 111 - DNA, 1251 bp, Canis familiaris
  CDS (1)..(1248)
aggagacggagtaaatacagtaaagctaaacaagaagcagatgaagagaaacatttgaatcaaggtgttagaacttatgtggatccctttacatatgaagatcccaaccaagcagttcgagaatttgccaaagaaatcgacgcctcctgcattaagattgaaaaagtcataggagttggtgaatttggcgaagtatgcagcgggcgtctcaaagtgcctggcaagagagagatctgtgtagccatcaagacactgaaagctggttatacagacaaacagaggagagacttcctgagtgaggccagcatcatgggacagtttgaccacccgaacataattcacttggaaggcgttgtcaccaaatgtaaaccagtaatgatcataacagagtacatggagaatggctccttggatgcattcctcaggaagaatgatggcagatttactgtcattcagctggtgggcatgcttcgtggcatcgggtctgggatgaagtacttatctgatatgagctatgtgcatcgagatctagctgcacggaacattctggtcaatagcaacttggtctgcaaagtgtctgattttggcatgtcgcgagtgcttgaggatgatccggaagcagcttacaccaccaggggtggcaagattcctatccggtggaccgcgccagaagcaattgcctatcgtaaattcacatcagcgagtgatgtatggagctatggaatcgttatgtgggaagtgatgtcgtatggagagagaccctattgggatatgtccaatcaagacgtgattaaagccattgaggaaggctatcggctcccccctccaatggactgccccatcgccctccatcagctgatgctagactgctggcagaaggagagaagtgacaggccgaaattcgggcagattgtcaacatgttggacaaactcatccgcaaccccaacagcttgaagaggacgggaactgagagctccagacctaacactgccttgttggacccaagctcccctgaattctccgccgtggtatcagtgggcgattggctccaggccattaaaatggaccgatataaggataacttcacggctgctggttataccacactagaggctgtagtgcacatgaaccaggaggacctggcgaggatcggcatcacggccgtcacacaccagaacaagattttgagcagcgtccaggcgatgagaacccaaatgcaacagatccacggcaggatggttcccgtctga

SEQ ID NO: 112 - protein, 416 aa, Canis familiaris
RRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHMNQEDLARIGITAVTHQNKILSSVQAMRTQMQQIHGRMVPV

SEQ ID NO: 113 - DNA, 1251 bp, Pan troglodytes
  CDS (1)..(1248)
cggagacggagtaaatacagtaaagccaaacaagaagcggatgaagagaaacatttgaatcaaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 114 - protein, 416 aa, Pan troglodytes; identical to SEQ ID NO: 96

SEQ ID NO: 115 - DNA, 1254 bp, Pan troglodytes
  CDS (1)..(1251)
cggagacggagtaaatacagtaaagccaaacaagaagcggatgaagagaaacatttgaatcaaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggttgggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 116 - protein, 417 aa, Pan troglodytes
RRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRLGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 117 - DNA, 1251 bp, Pan troglodytes; identical to SEQ ID NO: 113
  CDS (1)..(1248)

SEQ ID NO: 118 - protein, 416 aa, Pan troglodytes; identical to SEQ ID NO: 96

SEQ ID NO: 119 - DNA, 1197 bp, Pan troglodytes
  CDS (1)..(1194)
cggagacggagtaaatacagtaaagccaaacaagaagcggatgaagagaaacatttgaatcaaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggacagtgtccaggcaatgcgaacccaaatgcagcagatgcacggcagaatggttcccgtctga

SEQ ID NO: 120 - protein, 398 aa, Pan troglodytes
RRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQDSVQAMRTQMQQMHGRMVPV

SEQ ID NO: 121 - DNA, 1251 bp, Macaca mulatta
  CDS (1)..(1248)
cggagacggagtaaatacagtaaagccaaacaagaagcggatgaagagaaacatttgaatcaaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 122 - protein, 416 aa, Macaca mulatta; identical to SEQ ID NO: 96

SEQ ID NO: 123 - DNA, 1197 bp, Macaca mulatta
  CDS (1)..(1194)
cggagacggagtaaatacagtaaagccaaacaagaagcggatgaagagaaacatttgaatcaaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggacagcgtccaggcaatgcgaacccaaatgcagcagatgcacggcagaatggttcctgtctga

SEQ ID NO: 124 - protein, 398 aa, Macaca mulatta; identical to SEQ ID NO: 120

SEQ ID NO: 125 - DNA, 1215 bp, Macaca mulatta
  CDS (1)..(1212)
cggagacggagtaaatacagtaaagccaaacaagaagcggatgaagagaaacatttgaatcaaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtccccacagggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 126 - protein, 404 aa, Macaca mulatta
RRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSPQGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 127 - DNA, 1269 bp, Macaca mulatta
  CDS (1)..(1266)
cggagacggagtaaatacagtaaagccaaacaagaagcggatgaagagaaacatttgaatcaaggtcatgtttattacttaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 128 - protein, 422 aa, Macaca mulatta
RRRSKYSKAKQEADEEKHLNQGHVYYLGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 129 - DNA, 1251 bp, Gallus gallus
  CDS (1)..(1248)
aggaggcgcagcaaatacagtaaagctaagcaagaggcagatgaggagaaacatttgaaccaaggtgtcagaacatatgtggatccttttacatatgaggatccaaatcaagctgtgagggaatttgccaaagaaattgatgcctcctgcataaagattgagaaagttattggtgtgggggaatttggtgaagtatgcagtggacgtctcaaagttccaggaaaaagagaaatctgtgtggctatcaagactctgaaagctggttacactgacaaacaacggagagacttcctgagtgaggccagcatcatgggacaatttgaccaccccaatatcatccacttggaaggcgttgttactaaatgtaaaccagtaatgatcataactgagtacatggagaatggctccttggatgccttcctccggaagaatgatggcagatttacagtaatccagttggtggggatgcttcgtggcatcggctcaggaatgaagtatctgtctgacatgagctatgtgcatcgggatctagctgctcgaaacatactggtcaacagcaacttggtctgcaaagtgtctgacttcggcatgtcccgtgtcctggaagatgaccctgaggcagcttataccacacggggtggcaagatccctatccgatggactgcaccagaggcaattgcctaccgtaaatttacatcggctagtgacgtgtggagctatggcatcgtcatgtgggaagtgatgtcctatggagagagaccttactgggatatgtccaatcaagacgttattaaagccattgaggaagggtatcggttgccacccccaatggactgccccattgctctccatcagctgatgttagactgctggcagaaggaacgcagcgacagacctaaatttggacagattgtcaacatgctggacaaactcatccgcaaccctaacagcctgaagaggacaggcagcgagagctccagacccagcacagccctgctggatcccagctccccggagttctcggcggttgtttctgtcagtgactggctccaagccattaaaatggagcgatacaaggataacttcacagctgctggctataccaccctagaggctgtggtgcatatgaaccaggacgacctggccaggatcgggatcactgccatcacacaccagaacaagatcttgagcagcgttcaagccatgcgcagccaaatgcaacagatgcacggcaggatggtgcccgtctga

SEQ ID NO: 130 - protein, 416 aa, Gallus gallus
RRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPSTALLDPSSPEFSAVVSVSDWLQAIKMERYKDNFTAAGYTTLEAVVHMNQDDLARIGITAITHQNKILSSVQAMRSQMQQMHGRMVPV

SEQ ID NO: 131 - DNA, 1254 bp, Xenopus laevis
  CDS (1)..(1251)
agaagacggagtaaatacagtaaagccaagcaggaagcagacgaggaaaaacatttaaaccaaggagtaaagacttatgtggacccatttacatatgaagatcctaaccaggctgtccgcgaatttgcaaaggaaatcgatgcctcttgtattaagatcgaaaaagtaattggagtaggtgaatttggtgaagtgtgcagtgggcgtctgaaggtccctggaaagagagagatttatgttgcaattaagaccctgaaagctggttacaccgataagcagaggagagactttctcagtgaggccagcatcatgggtcagtttgaccatcctaacatcatccaccttgaaggtgttgtcaccaaatgcaagccagtgatgataatcaccgagtacatggagaacggatccttggatgcattccttcggaagaatgatggtcggtttacagtaatacagcttgtgggaatgctgcgtggcattgggtctggaatgaaatacctttcggacatgagttatgtgcaccgggacctagctgctcgtaatatccttgtgaacagcaacctagtctgtaaggtctctgactttggcatgtctcgggtgctggaagatgaccctgaagcagcctacacaaccaggggtggcaagatcccaatccgatggactgcaccagaagctattgcatacaggaaattcacttctgctagtgatgtctggagctatggcattgtcatgtgggaagtcatgtcttatggagagaggccttactgggatatgtccaatcaagatgtaattaaagcaatcgaggaaggatacaggctgcccccgcctatggactgccctattgcactgcatcagctcatgttggactgctggcagaaggatcgtagtgaccgaccaaaatttgggcagatagtcagcatgctggataaactcatcaggaacccaaacagtttgaaaaggactgggctggagaattcaagcagaacaaatacggctctgctggaccccagttcgcctgaatggtcccaggtggcttctgtgcttgattggctgcaggccatcaaaatggaaagatacaaagataacttcacagcagccggatacaccagcttggaagcagtcgtgcatgtgaatcaagatgacttgaccaggattggcattagttccccttcacaccagaacaagatcctgagcagcgtccaaggaatgaggacccagttgcagcaaatgcaaggcaggatggttcctgtttga

SEQ ID NO: 132 - protein, 417 aa, Xenopus laevis
RRRSKYSKAKQEADEEKHLNQGVKTYVDPFTYEDPNQAVREFAKEIDASCIKIEKVIGVGEFGEVCSGRLKVPGKREIYVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKDRSDRPKFGQIVSMLDKLIRNPNSLKRTGLENSSRTNTALLDPSSPEWSQVASVLDWLQAIKMERYKDNFTAAGYTSLEAVVHVNQDDLTRIGISSPSHQNKILSSVQGMRTQLQQMQGRMVPV

SEQ ID NO: 133 - DNA, 1251 bp, Xenopus laevis
  CDS (1)..(1248)
agaagacggagtaaatacagtaaagccaagcaggaagcagacgaggaaaaacatttaaaccaaggagtaaagacttatgtggacccatttacatatgaagatcctaaccaggctgtccgcgaatttgcaaaggaaatcgatgcctcttgtattaagatcgaaaaagtaattggagtaggtgaatttggtgaagtgtgcagtgggcgtctgaaggtccctggaaagagagagatttatgttgcaattaagaccctgaaagctggttacaccgataagcagaggagagactttctcagtgaggccagcatcatgggtcagtttgaccatcctaacatcatccaccttgaaggtgttgtcaccaaatgcaagccagtgatgataatcaccgagtacatggagaacggatccttggatgcattccttcggaagaatgatggtcggtttacagtaatacagcttgtgggaatgctgcgtggcattgggtctggaatgaaatacctttcggacatgagttatgtgcaccgggacctagctgctcgtaatatccttgtgaacagcaacctagtctgtaaggtctctgactttggcatgtctcgggtgctggaagatgaccctgaagcagcctacacaacaaggggtggcaagatcccaatccgatggactgcaccagaagctattgcatacaggaaattcacttctgctagtgatgtctggagctatggcattgtcatgtgggaagtcatgtcttatggagagaggccttactgggatatgtccaatcaagatgtaattaaagcaatcgaggaaggatacaggctgcccccgcctatggactgccctattgcactacatcagctcatgttggactgctggcagaaggatcgtagtgaccgaccaaaatttgggcagatagtcagcatgctggataaactcatcaggaacccaaacagtttgaaaaggactgggctggagaattcaagaacaaacacggctctgctggaccccagttcgcctgaatggtcccaggtggcttctgtgcttgattggctgcaggcatcaaaatggaaaagatacaaagataacttcacagcggccggatacaccagcttggaagcagtcgtgcatgtgaatcaagatgacttgaccaggattggcattagttccccttcacaccagaacaagatcctgagcagcgtccaaggaatgaggacccagttgcagcaaatgcaaggcagaatggttcctgtttga

SEQ ID NO: 134 - protein, 416 aa, Xenopus laevis
RRRSKYSKAKQEADEEKHLNQGVKTYVDPFTYEDPNQAVREFAKEIDASCIKIEKVIGVGEFGEVCSGRLKVPGKREIYVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKDRSDRPKFGQIVSMLDKLIRNPNSLKRTGLENSRTNTALLDPSSPEWSQVASVLDWLQASKWKRYKDNFTAAGYTSLEAVVHVNQDDLTRIGISSPSHQNKILSSVQGMRTQLQQMQGRMVPV

SEQ ID NO: 135 - DNA, 1254 bp, Xenopus laevis
  CDS (1)..(1251)
agaaggcggagtaaatacagtaaagccaagcaagaagcagatgaggaaaaacatttaaaccaaggagtgaagacgtatgtggacccatttacttatgaagatcctaaccaggcagtccgtgaatttgcaaaggaaatcgatgcctcttgtattaagatcgaaaaagtcattggagtaggtgaatttggtgaagtttgtagtgggcgtctgaaggtccccggaaagagagagatttatgttgcaataaagactttgaaagctggttacaccgataagcagaggagagactttctaagtgaggccagcatcatgggtcagtttgaccatcccaacatcatccaccttgaaggtgttgtcaccaaatgcaagccagtgatgataattaccgagtacatggagaacggatccttggatgcattccttcgaaagaatgacgggcggtttacggtgatacagcttgtgggaatactgcgtggcattgggtctggaatgaaatacctctcagatatgagttatgtacatcgggacctagctgctcgtaatatccttgtgaacagcaatctagtctgtaaggtctctgacttcggcatgtctcgagtgctggaagatgaccctgaagcagcctacacaaccaggggtggcaagatcccgatccgatggacagcaccagaagctattgcgtacaggaaattcacctctgccagcgatgtctggagctatggcattgtcatgtgggaagtcatgtcttatggagagaggccctactgggatatgtccaatcaagacgttattaaagcaatcgaggaaggatacaggctgcccccaccaatggactgccctatcgcactgcatcagctcatgttggactgctggcagaaggagcgtagtgaccgaccaaagtttgggcaaatagtcagcatgctggataagctcatcaggaacccaaacagtttgaaaaggactggtctggacaattcaagcagaacaaatacgactctgctggaccccagctcgcctgaatggtcccaggtggcttctgtgcttgattggctgcaggccatcaaaatggaaagatacaaagataacttcacagcggccggatacaccagcttggaagcagtcgtgcatgtaaatcaagatgacctgaccaggattggcattagttccccttcacaccagaacaagattctgagcagtgttcagggaatgaggacccagatgcagcaaattcaaggcaggatggttcctgtttga

SEQ ID NO: 136 - protein, 417 aa, Xenopus laevis
RRRSKYSKAKQEADEEKHLNQGVKTYVDPFTYEDPNQAVREFAKEIDASCIKIEKVIGVGEFGEVCSGRLKVPGKREIYVAIKTLKAGYTDKQRRDFLSEASIMGQFDHPNIIHLEGVVTKCKPVMIITEYMENGSLDAFLRKNDGRFTVIQLVGILRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVSMLDKLIRNPNSLKRTGLDNSSRTNTTLLDPSSPEWSQVASVLDWLQAIKMERYKDNFTAAGYTSLEAVVHVNQDDLTRIGISSPSHQNKILSSVQGMRTQMQQIQGRMVPV

SEQ ID NO: 137 - DNA, 1254 bp, Danio rerio
  CDS (1)..(1251)
cgcaggagaagcaaatacagcaaagccaagcaggattctgatgaggagaggcatttacacccaggagtccggatctatgtggaccccttcacatacgaggaccccaaccaagcagtccgtgaattcgctaaagaaatcgacgcctcctgcatcaagatcgaaaaggtcatcggcattggagaattcggagaggtgtgcagtggccgtctcaagatgcctggaaagcgtgagatctgtgtggccataaaaaccctaaaggcaggatacaccgacaagcaaaggcgggattttctgagcgaggccagcatcatgggccagtttgaccaccctaacatcatccgattggagggagttgtcactaaatgtaagccagttatgatcatcacagagtacatggagaacggatcactggatgcttttcttaggaagaatgatggacggtttacagtgattcagctggtgggcatcctgcgaggcattgcttcaggaatgaaatatctctccgatatgagctatgtccatcgtgacttggcggctcgcaacattctggtcaacagcaacctggtgtgcaaagtgtccgactttggcatgtctcgagttttggaggaagacccagatgctgcttataccaccagaggaggcaagatacccattcgctggacggctcctgaagccattacttacaggaagttcacctccgcatctgacgtctggagctatggcatcgtcatgtgggaagtgatgtcatatggagagcggccatattgggacatgagcaaccaggatgtgataaaggccattgaggaaggctacaggctgcctcctcccatggactgtccagtttctttgcaccagttgatgttggattgctggcagaaagagcgcgcagaaaggccaaagttcagtcaaattgtcaacatgctggacaaactcatccgcaaccctaacagcctgaaaaggacaggaggagaaatagccagacccaacaccaccctcctggagcctagcagcccagaattcacgtctaccctgggatcagttgccgactggctgcaggccatcaacatggaacgttacagagacaacttcaccgctgctggctataccactccagaagctgtggtccatatgacacaagaggacatgacgaggatagggatctccaccgccgcacaccaggataagatcctcaacagcgcgcagggaatgttgtcccagatgcagcaaatgcaggacaggatggttcctgtctga

SEQ ID NO: 138 - protein, 417 aa, Danio rerio
RRRSKYSKAKQDSDEERHLHPGVRIYVDPFTYEDPNQAVREFAKEIDASCIKIEKVIGIGEFGEVCSGRLKMPGKREICVAIKTLKAGYTDKQRRDFLSEASIMGQFDHPNIIRLEGVVTKCKPVMIITEYMENGSLDAFLRKNDGRFTVIQLVGILRGIASGMKYLSDMSYVHRDLAARNILVNSNLVCKVSDFGMSRVLEEDPDAAYTTRGGKIPIRWTAPEAITYRKFTSASDVWSYGIVMWEVMSYGERPYWDMSNQDVIKAIEEGYRLPPPMDCPVSLHQLMLDCWQKERAERPKFSQIVNMLDKLIRNPNSLKRTGGEIARPNTTLLEPSSPEFTSTLGSVADWLQAINMERYRDNFTAAGYTTPEAVVHMTQEDMTRIGISTAAHQDKILNSAQGMLSQMQQMQDRMVPV

SEQ ID NO: 139 - DNA, 1254 bp, Danio rerio
  CDS (1)..(1251)
cgcaggagaagcaaatacagcaaagccaagcaggattctgatgaggagaggcatttacacccaggagtccggatctatgtggaccccttcacatacgaggaccccaaccaagcagtccgtgaattcgctaaagaaatcgacgcctcctgcatcaagatcgaaaaggtcatcggcattggagaattcggagaggtgtgcagtggccgtctcaagatgcctggaaagcgtgagatctgtgtggccataaaaaccctaaaggcaggatacaccgacaagcaaaggcgggattttctgagcgaggccagcatcatgggccagtttgaccaccctaacatcatccgattggagggagttgtcactaaatgtaagccagttatgatcatcacagagtacatggagaacggatcacttgatgcttttcttaggaagaatgatggacggtttacagtgattcagctggtgggcatcctgcgaggcattgcttcaggaatgaaatatctctccgatatgagctatgtccatcgtgacttggcggctcgcaacattctggtcaacagcaacctggtgtgcaaagtgtccgactttggcatgtctcgagttttggaggaagacccagatgctgcttataccaccagaggaggcaagatacctattcgctggacggctcctgaagccattacttacaggaagttcacctccgcatctgacgtctggagctatggcatcgtcatgtgggaagtgatgtcatatggagagcggccatattgggacatgagcaaccaggatgtgataaaggccattgaggaaggctacaggctgcctcctcccatggactgtccagtttctttgcaccagttgatgttggattgctggcagaaagagcgcgcagaaaggccaaagttcagtcaaattgtcaacatgctggacaaactcatccgcaaccctaacagcctgaaaaggacaggaggagaaatagccagacccaacaccaccctcctggagcctagcagcccagaattcacgtctaccctgggatcagttgccgactggctgcaggccatcaacatggaacgttacagagacaacttcaccgctgctggctataccactccagaagctgtggtccatatgacacaagaggacatgacgaggatagggatctccaccgctgcacaccaggataagatcctcaacagcgcgcagggaatgttgtcccagatgcagcaaatgcaggacaggatggttcctgtctga

SEQ ID NO: 140 - protein, 417 aa, Danio rerio; identical to SEQ ID NO: 138

SEQ ID NO: 141 - DNA, 1272 bp, Mus musculus
  CDS (1)..(1269)
attgcagcttttgtgatcagccgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaatcgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagcgacaggcctaaatttgggcagatcgttaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctga

SEQ ID NO: 142 - protein, 423 aa, Mus musculus
IAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 143 - DNA, 1272 bp, Mus musculus
  CDS (1)..(1269)
attgcagcttttgtgatcagccgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaattgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagtgacaggcctaaatttgggcagatcgtcaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctga

SEQ ID NO: 144 - protein, 423 aa, Mus musculus; identical to SEQ ID NO: 142

SEQ ID NO: 145 - DNA, 1272 bp, Homo sapiens
  CDS (1)..(1269)
attgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 146 - protein, 423 aa, Homo sapiens
IAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 147 - DNA, 1272 bp, Homo sapiens; identical to SEQ ID NO: 145
  CDS (1)..(1269)

SEQ ID NO: 148 - protein, 423 aa, Homo sapiens; identical to SEQ ID NO: 146

SEQ ID NO: 149 - DNA, 1272 bp, Macaca mulatta
  CDS (1)..(1269)
attgcagcttttgtcatcagccggagacggagtaaatacagtaaagccaaacaagaagcggatgaagagaaacatttgaatcaaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 150 - protein, 423 aa, Macaca mulatta; identical to SEQ ID NO: 146

SEQ ID NO: 151 - DNA, 1290 bp, Macaca mulatta
  CDS (1)..(1287)
attgcagcttttgtcatcagccggagacggagtaaatacagtaaagccaaacaagaagcggatgaagagaaacatttgaatcaaggtcatgtttattacttaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 152 - protein, 429 aa, Macaca mulatta
IAAFVISRRRSKYSKAKQEADEEKHLNQGHVYYLGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 153 - DNA, 1272 bp, Pan troglodytes
  CDS (1)..(1269)
attgcagcttttgtcatcagccggagacggagtaaatacagtaaagccaaacaagaagcggatgaagagaaacatttgaatcaaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 154 - protein, 423 aa, Pan troglodytes; identical to SEQ ID NO: 146

SEQ ID NO: 155 - DNA, 1272 bp, Canis familiaris
  CDS (1)..(1269)
atcgcggcctttgtcatcagcaggagacggagtaaatacagtaaagctaaacaagaagcagatgaagagaaacatttgaatcaaggtgttagaacttatgtggatccctttacatatgaagatcccaaccaagcagttcgagaatttgccaaagaaatcgacgcctcctgcattaagattgaaaaagtcataggagttggtgaatttggcgaagtatgcagcgggcgtctcaaagtgcctggcaagagagagatctgtgtagccatcaagacactgaaagctggttatacagacaaacagaggagagacttcctgagtgaggccagcatcatgggacagtttgaccacccgaacataattcacttggaaggcgttgtcaccaaatgtaaaccagtaatgatcataacagagtacatggagaatggctccttggatgcattcctcaggaagaatgatggcagatttactgtcattcagctggtgggcatgcttcgtggcatcgggtctgggatgaagtacttatctgatatgagctatgtgcatcgagatctagctgcacggaacattctggtcaatagcaacttggtctgcaaagtgtctgattttggcatgtcgcgagtgcttgaggatgatccggaagcagcttacaccaccaggggtggcaagattcctatccggtggaccgcgccagaagcaattgcctatcgtaaattcacatcagcgagtgatgtatggagctatggaatcgttatgtgggaagtgatgtcgtatggagagagaccctattgggatatgtccaatcaagacgtgattaaagccattgaggaaggctatcggctcccccctccaatggactgccccatcgccctccatcagctgatgctagactgctggcagaaggagagaagtgacaggccgaaattcgggcagattgtcaacatgttggacaaactcatccgcaaccccaacagcttgaagaggacgggaactgagagctccagacctaacactgccttgttggacccaagctcccctgaattctccgccgtggtatcagtgggcgattggctccaggccattaaaatggaccgatataaggataacttcacggctgctggttataccacactagaggctgtagtgcacatgaaccaggaggacctggcgaggatcggcatcacggccgtcacacaccagaacaagattttgagcagcgtccaggcgatgagaacccaaatgcaacagatccacggcaggatggttcccgtctga

SEQ ID NO: 156 - protein, 423 aa, Canis familiaris
IAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHMNQEDLARIGITAVTHQNKILSSVQAMRTQMQQIHGRMVPV

SEQ ID NO: 157 - DNA, 1269 bp, Equus caballus
  CDS (1)..(1269)
atcgcagcctttgtcatcagtaggagacggagtaaatacagtaaagcaaaacaagaagcagatgaagagaaacatttgaatcaaggtgttagaacttatgtggatccttttacatacgaagatcccaaccaagcagttcgagaatttgccaaagaaatcgacgcatcttgcattaagattgaaaaagtcataggagttggtgaatttggcgaagtatgcagtgggcgtctcaaagtgcctggcaagagagagatctgtgtggccatcaagacactgaaagctggttatacagacaaacagaggagagacttcctgagcgaggccagcatcatgggacagtttgaccacccgaatataattcacctggaaggcgtcgtcaccaaatgtaaaccggtaatgatcataacagagtacatggagaatggctccttggatgcattcctcaggaagaatgacggcagatttacagtcattcagctggtgggcatgcttcgtggcattgggtctgggatgaagtatttatctgatatgagctatgtgcatcgagatctggctgcacggaacattctggtgaatagcaacttggtctgcaaagtgtctgattttggcatgtcgcgagtgcttgaggatgacccggaagcagcttataccaccaggggtggcaagattcctatccggtggactgcgccagaagcaattgcctatcgtaaattcacatcagcaagtgatgtatggagctatggaatcgttatgtgggaagtgatgtcgtatggagagagaccttattgggatatgtccaatcaagatgtgattaaagccattgaggaaggctatcgactaccccctccaatggactgccccattgccctccaccagctgatgctagactgctggcagaaggagagaagtgacaggcccaaatttgggcagattgtcaacatgttggacaaactcatccgcaaccccaacagcttgaagaggacggggactgagagctccagacctaacactgccttgttggatccgagctccccggaattctccgccgtagtatcggtgggcgattggctccaggccattaaaatggaccggtataaggataacttcacggctgctggttataccacactagaggctgtagtgcacgtgaaccaggatgacctggcaagaattgggatcaccgctgtcacacaccagaataagattttgagcagtgtccaggcgatgagaacccaaatgcagcagatacacggcagaatggttcctgtc

SEQ ID NO: 158 - protein, 423 aa, Equus caballus
IAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQDDLARIGITAVTHQNKILSSVQAMRTQMQQIHGRMVPV

SEQ ID NO: 159 - DNA, 1269 bp, Gallus gallus
  CDS (1)..(1269)
attgcagcctttgtcatcagcaggaggcgcagcaaatacagtaaagctaagcaagaggcagatgaggagaaacatttgaaccaaggtgtcagaacatatgtggatccttttacatatgaggatccaaatcaagctgtgagggaatttgccaaagaaattgatgcctcctgcataaagattgagaaagttattggtgtgggggaatttggtgaagtatgcagtggacgtctcaaagttccaggaaaaagagaaatctgtgtggctatcaagactctgaaagctggttacactgacaaacaacggagagacttcctgagtgaggccagcatcatgggacaatttgaccaccccaatatcatccacttggaaggcgttgttactaaatgtaaaccagtaatgatcataactgagtacatggagaatggctccttggatgccttcctccggaagaatgatggcagatttacagtaatccagttggtggggatgcttcgtggcatcggctcaggaatgaagtatctgtctgacatgagctatgtgcatcgggatctagctgctcgaaacatactggtcaacagcaacttggtctgcaaagtgtctgactttggcatgtcccgtgtcctggaagatgaccctgaggcagcttataccacacggggtggcaagatccctatccgatggactgcaccagaggcaattgcctaccgtaaatttacatcggctagtgacgtgtggagctatggcatcgtcatgtgggaagtgatgtcctatggagagagaccttactgggatatgtccaatcaagacgttattaaagccattgaggaagggtatcggttgccacccccaatggactgccccattgctctccatcagctgatgttagactgctggcagaaggaacgcagcgacagacctaaatttggacagattgtcaacatgctggacaaactcatccgcaaccctaacagcctgaagaggacaggcagcgagagctccagacccagcacagccctgctggatcccagctccccggagttctcggcggttgtttctgtcagtgactggctccaagccattaaaatggagcgatacaaggataacttcacagctgctggctataccaccctagaggctgtggtgcatatgaaccaggacgacctggccaggatcgggatcactgccatcacacaccagaacaagatcttgagcagcgttcaagccatgcgcagccaaatgcaacagatgcacggcaggatggtgcccgtc

SEQ ID NO: 160 - protein, 423 aa, Gallus gallus
IAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPSTALLDPSSPEFSAVVSVSDWLQAIKMERYKDNFTAAGYTTLEAVVHMNQDDLARIGITAITHQNKILSSVQAMRSQMQQMHGRMVPV

SEQ ID NO: 161 - DNA, 1269 bp, Sus scrofa
  CDS (1)..(1269)
atcgccgcctttgtcatcagcaggagacgaagtaaatacagtaaagcaaagcaagaagcagatgaagagaaacatttgaatcaaggtgttagaacttacgtggacccctttacctacgaagatcccaatcaagcagttcgagaatttgccaaagaaatcgacgcatcctgcattaagatcgaaaaagtcatcggagttggtgaatttggtgaagtatgcagtgggcgtctcaaagtgcctggcaaaagagaaatttatgtggctatcaagacgctgaaagctggttatacagacaaacagaggagggacttcctgagtgaggccagcatcatgggacagttcgaccaccccaatatcattcacttggaaggcgtcgtcaccaaatgtaaaccagtaatgatcataacagagtacatggagaacggctccttggacgcattcctcaggaagaatgatggcaggtttacggtcattcagctggtgggcatgcttcgtggcattgggtccgggatgaagtatttatcggatatgagctacgtgcatcgagacctggctgcacggaacattctagtcaatagcaacttggtctgcaaagtgtctgatttcggcatgtcccgggtgctggaggatgatccagaagccgcttatactaccaggggtggcaagattcctatccggtggactgcgccagaagcaattgcctatcgtaaattcacatcagcaagtgatgtatggagctacgggatcgttatgtgggaagtgatgtcgtatggagagagaccctactgggacatgtccaatcaagatgtgattaaagccatcgaggaaggctatcggctgccccctccaatggactgccccattgcactccaccagctgatgctggactgctggcagaaggagagaagcgacaggccgaaatttgggcagattgtcaacatgttggacaaactcatccgcaaccccaacagcttgaagaggacggggaccgagagctccagacctaacactgccttgttggatccaagctcccctgagttctctgccgtggtatcggtgggtgattggctccaggccattaaaatggaccgatataaggataacttcactgctgctggttataccacactagaggctgtagtgcacatgaaccaggatgacctggccagaattggcatcacggctgtcacacaccagaataagattttgaacagcatccaggcgatgagaacccaaatgcaacagatacacggcagaatggttcccgtc

SEQ ID NO: 162 - protein, 423 aa, Sus scrofa
IAAFVISRRRSKYSKAKQEADEEKHLNQGVRTYVDPFTYEDPNQAVREFAKEIDASCIKIEKVIGVGEFGEVCSGRLKVPGKREIYVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHMNQDDLARIGITAVTHQNKILNSIQAMRTQMQQIHGRMVPV

SEQ ID NO: 163 - DNA, 1269 bp, Ornithorhynchus anatinus
  CDS (1)..(1269)
attgctgcatttgtcatcagcagaagacgcagtaaatacagcaaggctaagcaagaagcggatgaagagaaacatttgaatcaaggggtgagaacctatgtggatccttttacctatgaagatcctaaccaagctgtccgagaatttgccaaggaaatagatgcctcttgcatcaagattgaaaaagtcattggagttggtgagtttggcgaagtatgcagtgggcgtctcaaagtgcctggcaagcgggagatctgtgtggcaattaagactctcaaagcagggtatacggacaaacaaaggagggacttcttgagtgaggccagcatcatggggcagtttgaccaccctaatatcatccacttagaaggcgtcgtcaccaaatgtaagccagtaatgatcataaccgagtacatggaaaatggatccttggatgcattcctgaggaagaatgatggccgatttacagtcatacagttggtggggatgcttcgtggcattggctcgggaatgaagtatctgtccgatatgagttacgtgcatagggatctagctgcccgaaacatcctggtaaatagtaacctggtctgcaaagtgtccgattttggcatgtctcgagtacttgaggatgatcccgaagctgcttatacgacaaggggcggcaagattcccatccggtggactgcaccagaagcgatcgcatatcgtaaattcacatcagcaagtgatgtgtggagctatggaattgtaatgtgggaagtgatgtcatatggggagagaccgtactgggacatgtccaatcaagacgtaattaaagccatcgaagaaggatatagactacctccccctatggactgtcccattgcactccatcagctgatgcttgactgttggcagaaggagagaagtgacaggcctaaatttggacagattgtcaatatgttggacaaactcatccgcaaccccaacagcttgaagaggacgggcacggagagctccagacctaatactgccttgttggacccaagttctcctgaattctctgctgtggtgtcagtgactgactggctccaggccattaaaatggagcggtacaaggataacttcacagctgctggctacaccaccctagaggctgtggtgcacatgaaccaggacgacctgacaagaattggcatcaccgccatcacacatcagaacaagattttgggcagcgtccagtcaatgcggacccaaatgcaacagatgcacggcagaatggttcccgtc

SEQ ID NO: 164 - protein, 423 aa, Ornithorhynchus anatinus
IAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVTDWLQAIKMERYKDNFTAAGYTTLEAVVHMNQDDLTRIGITAITHQNKILGSVQSMRTQMQQMHGRMVPV

SEQ ID NO: 165 - DNA, 1275 bp, Xenopus laevis
  CDS (1)..(1272)
attgctgcttttgtcatcagcagaagacggagtaaatacagtaaagccaagcaggaagcagacgaggaaaaacatttaaaccaaggagtaaagacttatgtggacccatttacatatgaagatcctaaccaggctgtccgcgaatttgcaaaggaaatcgatgcctcttgtattaagatcgaaaaagtaattggagtaggtgaatttggtgaagtgtgcagtgggcgtctgaaggtccctggaaagagagagatttatgttgcaattaagaccctgaaagctggttacaccgataagcagaggagagactttctcagtgaggccagcatcatgggtcagtttgaccatcctaacatcatccaccttgaaggtgttgtcaccaaatgcaagccagtgatgataatcaccgagtacatggagaacggatccttggatgcattccttcggaagaatgatggtcggtttacagtaatacagcttgtgggaatgctgcgtggcattgggtctggaatgaaatacctttcggacatgagttatgtgcaccgggacctagctgctcgtaatatccttgtgaacagcaacctagtctgtaaggtctctgactttggcatgtctcgggtgctggaagatgaccctgaagcagcctacacaaccaggggtggcaagatcccaatccgatggactgcaccagaagctattgcatacaggaaattcacttctgctagtgatgtctggagctatggcattgtcatgtgggaagtcatgtcttatggagagaggccttactgggatatgtccaatcaagatgtaattaaagcaatcgaggaaggatacaggctgcccccgcctatggactgccctattgcactgcatcagctcatgttggactgctggcagaaggatcgtagtgaccgaccaaaatttgggcagatagtcagcatgctggataaactcatcaggaacccaaacagtttgaaaaggactgggctggagaattcaagcagaacaaatacggctctgctggaccccagttcgcctgaatggtcccaggtggcttctgtgcttgattggctgcaggccatcaaaatggaaagatacaaagataacttcacagcagccggatacaccagcttggaagcagtcgtgcatgtgaatcaagatgacttgaccaggattggcattagttccccttcacaccagaacaagatcctgagcagcgtccaaggaatgaggacccagttgcagcaaatgcaaggcaggatggttcctgtttga

SEQ ID NO: 166 - protein, 424 aa, Xenopus laevis
IAAFVISRRRSKYSKAKQEADEEKHLNQGVKTYVDPFTYEDPNQAVREFAKEIDASCIKIEKVIGVGEFGEVCSGRLKVPGKREIYVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKDRSDRPKFGQIVSMLDKLIRNPNSLKRTGLENSSRTNTALLDPSSPEWSQVASVLDWLQAIKMERYKDNFTAAGYTSLEAVVHVNQDDLTRIGISSPSHQNKILSSVQGMRTQLQQMQGRMVPV

SEQ ID NO: 167 - DNA, 1248 bp, Rattus norvegicus
  CDS (1)..(1245)
atggactacccatacgacgtcccagactacgctacgcgtgtcgacaagcatttgaatcaaggtgttagaacatacgtggatccctttacatatgaagaccccaaccaggcagttcgagaatttgccaaagaaatcgatgcctcctgcattaaaatcgaaaaggtcattggagttggcgaatttggagaagtctgcagtgggcgtctcaaagtgcccggcaagagagagatctgtgtggccatcaagactctgaaagctggttatactgacaagcagaggagagacttcctgagcgaggccagcatcatgggacagtttgaccacccaaacataatccacctggaaggcgttgtcaccaaatgtaaaccagtaatgatcatcacggagtacatggagaacggctccttggacgctttcctcaggaagaatgatggccgatttacagtcattcagctggtgggcatgctccgaggcattggctcggggatgaagtatttatctgatatgagctatgtgcatcgagacctggctgccaggaacattctggtaaatagcaacttggtctgcaaggtgtctgatttcggcatgtccagggtgcttgaggatgacccggaagcagcctatactaccaggggcggcaagattcccatccggtggactgcaccagaagcaattgcgtatcgtaaatttacctcagccagtgacgtctggagctacggaatcgttatgtgggaagtgatgtcatatggagagaggccgtactgggatatgtccaatcaagatgtgatcaaagccatcgaggaagggtaccggctacccccgccaatggactgccccattgccctccatcagttaatgctggactgttggcagaaagagagaagcgacaggcctaaatttgggcagatcgtcaacatgttggacaaactcatccgcaaccccaacagcctgaagaggacagggccagagagttccagaccaaacacagccttgttagatcccagctcccctgaattctccgccgtagtatcagtgggtgactggctgcaggccatcaaaatggaccggtataaggacaacttcacagccgccgggtacacgacactagaagctgtggttcacatgagccaggatgacctggcgcgaattggcatcaccgcaatcacgcaccagaataagattttgagcagcgtccaggcgatgcgaacccagatgcagcagatgcatggcaggatggttcctgtctga

SEQ ID NO: 168 - protein, 415 aa, Rattus norvegicus
MDYPYDVPDYATRVDKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGPESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 169 - DNA, 1143 bp, Rattus norvegicus
  CDS (1)..(1140)
atggactacccatacgacgtcccagactacgctacgcgtgtcgacaaaatcgaaaaggtcattggagttggcgaatttggagaagtctgcagtgggcgtctcaaagtgcccggcaagagagagatctgtgtggccatcaagactctgaaagctggttatactgacaagcagaggagagacttcctgagcgaggccagcatcatgggacagtttgaccacccaaacataatccacctggaaggcgttgtcaccaaatgtaaaccagtaatgatcatcacggagtacatggagaacggctccttggacgctttcctcaggaagaatgatggccgatttacagtcattcagctggtgggcatgctccgaggcattggctcggggatgaagtatttatctgatatgagctatgtgcatcgagacctggctgccaggaacattctggtaaatagcaacttggtctgcaaggtgtctgatttcggcatgtccagggtgcttgaggatgacccggaagcagcctatactaccaggggcggcaagattcccatccggtggactgcaccagaagcaattgcgtatcgtaaatttacctcagccagtgacgtctggagctacggaatcgttatgtgggaagtgatgtcatatggagagaggccgtactgggatatgtccaatcaagatgtgatcaaagccatcgaggaagggtaccggctacccccgccaatggactgccccattgccctccatcagttaatgctggactgttggcagaaagagagaagcgacaggcctaaatttgggcagatcgtcaacatgttggacaaactcatccgcaaccccaacagcctgaagaggacagggccagagagttccagaccaaacacagccttgttagatcccagctcccctgaattctccgccgtagtatcagtgggtgactggctgcaggccatcaaaatggaccggtataaggacaacttcacagccgccgggtacacgacactagaagctgtggttcacatgagccaggatgacctggcgcgaattggcatcaccgcaatcacgcaccagaataagattttgagcagcgtccaggcgatgcgaacccagatgcagcagatgcatggcaggatggttcctgtctga

SEQ ID NO: 170 - protein, 380 aa, Rattus norvegicus
MDYPYDVPDYATRVDKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGPESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 171 - DNA, 1026 bp, Rattus norvegicus
  CDS (1)..(1023)
atggactacccatacgacgtcccagactacgctacgcgtgtcgacgacaagcagaggagagacttcctgagcgaggccagcatcatgggacagtttgaccacccaaacataatccacctggaaggcgttgtcaccaaatgtaaaccagtaatgatcatcacggagtacatggagaacggctccttggacgctttcctcaggaagaatgatggccgatttacagtcattcagctggtgggcatgctccgaggcattggctcggggatgaagtatttatctgatatgagctatgtgcatcgagacctggctgccaggaacattctggtaaatagcaacttggtctgcaaggtgtctgatttcggcatgtccagggtgcttgaggatgacccggaagcagcctatactaccaggggcggcaagattcccatccggtggactgcaccagaagcaattgcgtatcgtaaatttacctcagccagtgacgtctggagctacggaatcgttatgtgggaagtgatgtcatatggagagaggccgtactgggatatgtccaatcaagatgtgatcaaagccatcgaggaagggtaccggctacccccgccaatggactgccccattgccctccatcagttaatgctggactgttggcagaaagagagaagcgacaggcctaaatttgggcagatcgtcaacatgttggacaaactcatccgcaaccccaacagcctgaagaggacagggccagagagttccagaccaaacacagccttgttagatcccagctcccctgaattctccgccgtagtatcagtgggtgactggctgcaggccatcaaaatggaccggtataaggacaacttcacagccgccgggtacacgacactagaagctgtggttcacatgagccaggatgacctggcgcgaattggcatcaccgcaatcacgcaccagaataagattttgagcagcgtccaggcgatgcgaacccagatgcagcagatgcatggcaggatggttcctgtctga

SEQ ID NO: 172 - protein, 341 aa, Rattus norvegicus
MDYPYDVPDYATRVDDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGPESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 173 - DNA, 906 bp, Rattus norvegicus
  CDS (1)..(903)
atggactacccatacgacgtcccagactacgctacgcgtgtcgactacatggagaacggctccttggacgctttcctcaggaagaatgatggccgatttacagtcattcagctggtgggcatgctccgaggcattggctcggggatgaagtatttatctgatatgagctatgtgcatcgagacctggctgccaggaacattctggtaaatagcaacttggtctgcaaggtgtctgatttcggcatgtccagggtgcttgaggatgacccggaagcagcctatactaccaggggcggcaagattcccatccggtggactgcaccagaagcaattgcgtatcgtaaatttacctcagccagtgacgtctggagctacggaatcgttatgtgggaagtgatgtcatatggagagaggccgtactgggatatgtccaatcaagatgtgatcaaagccatcgaggaagggtaccggctacccccgccaatggactgccccattgccctccatcagttaatgctggactgttggcagaaagagagaagcgacaggcctaaatttgggcagatcgtcaacatgttggacaaactcatccgcaaccccaacagcctgaagaggacagggccagagagttccagaccaaacacagccttgttagatcccagctcccctgaattctccgccgtagtatcagtgggtgactggctgcaggccatcaaaatggaccggtataaggacaacttcacagccgccgggtacacgacactagaagctgtggttcacatgagccaggatgacctggcgcgaattggcatcaccgcaatcacgcaccagaataagattttgagcagcgtccaggcgatgcgaacccagatgcagcagatgcatggcaggatggttcctgtctga

SEQ ID NO: 174 - protein, 301 aa, Rattus norvegicus
MDYPYDVPDYATRVDYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGPESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 175 - DNA, 3544 bp, Mus musculus
  CDS (150)..(2933)
tttcgtttctctttggaatttgcgacgctgtcaccggttctagggtataccccgcgaatgaagttactttattggattccagatctgttcagggagagcttgggtggatagcaagccctctggaaggagggtgggaggaagtgagcattatggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactattatgagtcggacaacgacaaggagcgcttcatcagagagagccagtttggcaagatcgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgataccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggatgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaacgagacatcggtgaacttggaatggagcagtcctcagaacacaggtggccgtcaggacatttcttacaacgtggtctgcaagaaatgtggagctggtgatcccagcaaatgccggccctgtggaagtggagtccactacacaccacagcagaacggactcaagacgaccagagtctccatcactgacctcctagcacacaccaattacacgtttgagatctgggcagtgaatgaagtgtctaagtataaccctagcccggaccagtccgtgtctgtcacagtgacaaccaaccaagcagcaccatcatccattgctttggtccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctcttacttcctatgttttccacgtgcgagccaggaccgctgctggctacggagacttcagcgagcccctggaagtcactactaatacagtgccttcccgcatcattggcgatggagccaactccactgtcctgctggtctctgtctctggcagtgtggtcctcgtggtcattctcattgcagcttttgtgatcagccgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaatcgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagcgacaggcctaaatttgggcagatcgttaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctgagccagtaccgaatagactcaaaactctcgaatagtttacctcatccatgcactttaattgaagaactgcactttttttactttgtcttcgccctctgaaattaaaggaaaacaaacaaacaaaaaacaaaaacaaaaatatctgcagcgttgcttggtgtaagagattgctgaaaccatggggcttataatgaatgaccttgatcatcagaattaaacctggagccagtaatttctcagaagaactctgtccatcgctggtgtgtaaaatacatgtacttatataaataaaactctgcctctgagtttcgatgctgtatttcccgtcagatactcggcttttcaagtcaccctaatcctttctctgtctggaatttcaagggaaggatttcatctgtggcattaataacagtcatcactccttaccagaaagaagacctgctgtgcccaggagcactgttaaaggactcaatggtggctttcagggctcggtttataccacagaagaaaatccaggtgaaagccacttggcccattcatgctgcctcttcagtggccaggacacctagtggatttttatgacaaagggggggttagaaaaaaaaaaaaaaa

SEQ ID NO: 176 - protein, 927 aa, Mus musculus; identical to SEQ ID NO: 16

SEQ ID NO: 177 - DNA, 6328 bp, Mus musculus
  CDS (58)..(3018)
taagcatttattccactgggatagaagcggcaggagcagcgttggcaccggcgaaccatggctgggattttctatttcatcctcttttcgtttctctttggaatttgcgacgctgtcaccggttctagggtataccccgcgaatgaagttactttattggattccagatctgttcagggagagcttgggtggatagcaagccctctggaaggagggtgggaggaagtgagcattatggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactactatgagtcggacaacgacaaggagcgcttcatcagagagagccagtttggcaagatcgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgataccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggacgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaacgagacatcggtgaacttggaatggagcagccctcagaacacaggtggccgtcaggacatttcttacaacgtggtctgcaagaaatgtggagctggtgatcccagcaagtgccggccctgtggaagtggagtccactacacaccacagcagaacggactcaagacgaccagagtctccatcactgacctcctagcacacaccaattacacgtttgagatctgggcagtgaatggagtgtctaagtataaccctagcccggaccagtccgtgtctgtcacagtgacaaccaaccaagcagcaccatcatccattgctttggtccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctctgacttcctatgtttttcacgtgcgagccaggaccgctgctggctacggagacttcagcgagcccctggaagtcactactaatacagtgccttcccgcatcattggcgatggagccaactccactgtcctgctggtctccgtctctggcagtgtggtcctcgtggtcattctcattgcagcttttgtgatcagccgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaattgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagtgacaggcctaaatttgggcagatcgtcaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctgagccagtaccgaatagactcaaaactctcgaatagtttacctcatccatgcactttaattgaagaactgcactttttttactttgtcttcgccctctgaaattaaaggaaaacaaacaaacaaaaaacaaaaacaaaaatatctgcagcgttgcttggtgtaagagattgctgaaaccatggggcttataatgaatgaccttgatcatcagaattaaacctggagccagtaatttctcagaagaactctgtccatcgctggtgtgtaaaatacatgtacttatataaataaaactctgcctctgagtttcgatgctgtatttcccgtcagaggcttttcaagtcaccctaatcctttctctgtctggaatttcaagggaaggatttcatctgtggcattaataacagtcatcactccttaccagaaagaagacctgctgtgcccaggagcactgttaaaggactcaatggtggctttcagggctcggtttataccacagaagaaaatccaggtgaaagccacttggcccattcatgctgcctcttcaatggccaggacacctggtggatttttatgacatagggggggttagaaagaaaagaaaatggatttttaaaacatgcgaactcccaagacctattaaccctaactggacaaatgaggtctctttggggctgaggctgtgccatataaagtcttctttgagaatgctacaaacttctcataactaccttatggatagtgggctgagacaatcctgaatggagaattttcacacacacacacacacaccccttcaaagaggcaactcccaaatttacaagggaatagattctggtatctcagcctcacagcccttcctgttgattacataagcgcttggaagaaaatagaacacaccctccaccgttccttctgaatgtttttctttggcttctcttctgccggtttttgaggcaaagacacgacaaaacacctgcacctgaacagcagaagaaatgtgtcaagtccccttcgcccaggaaaacgacatccagctttggcatctgttctcagctgcactgaggaatgtgctgtctcgaggcaccagctctgcagagcccttgctcccaaactccttgtggttttatttatacgtatttccatatttcattcctgtacggccccgctgcatccgtgtggcagcaagtgaccatatgttacaggttttactatggacgccaggtcaggcgccaccacgcagaacaaagccagttccgcaagctgcctccgatacgcaatgctaaagtgacattttacccagggtgtgccattgcagtgatataaatatatttttttcctagactaaaatatgacctgaatatctcttttgatgtgtgtacatagagtgtgtgtgtgtgtgtgtgtgtgtgtgtgtatgtgagtgtgtatggggtgtgtgtgtgtgtgtgtgtgtgtgtgtgtaacctcatgcttagaactgcctgtgaatgttgtggaatgctatacctggagagttctggtttattaccagttcaaagataaggaaagagtcacatgatatacaagacccggagaccatgtccgtccccttgggaagacagcttggaaacgctacatgttctttatctgtaagtgtaatgtgtctgtcacattcatcctaagaagcagttctttggacagatgttttcaccttgatggtggaatgatttttagatataagcctgactcgccgatttcacaatggagagagaaggggatggaatccaatttgtgaccccagatggagtataagtcgcctttgtttccctgcataaatgaacttgttgaatgcgaacaaatatatgcaattcatatacttttggaagatgaacttaagatatgtgtgtcagccttgagatgatgtgtctggagtaatactttgtgtcccagtgtcacagaaaaatacatacatgccagtggctcttgaggttaatgtagttgggatgaaatggcctctagcaattccaggttccccaattacatgtggaaagttctggtaattaatatgcagctaactacttatgcccttgaaagtataccagtcttctagaatcggagttctggtgtatgaagattcagtatcgacaggatatgtataccaaactccagccagcatactgccattttacttaacctgagaggctgccttgcttattctgagctatggtcacagaaactgtggccatttatataagctataacatcaaatcagggaattagaaaaaaaaaaaacggggaaaagattctgaaccatatattgttgaataagtaaagaaaatcaccaataaatatttattgcattctgacagggtgtatggcattgtattctcataactatgccagagtgacaaagttatttcaccccttttgaggggaccttaatatatttttaaagggatgtgcctatgcattgatgcctgaaaaataggtgtaaaaaaaaaaaaaaagatgaacctctgagtgcatcatctttcccagaggtcaggtgggaggaggtcaacttctgggtctgtgtccagcccaggagcaagcgctggccttgggagctggaaggctaaaatctagtcaaatctactaaacagctttgagctgttccctgcaccaaatcaagccgtttcaccacgtgtctgcaggctctgaggtttttattttttggcgatcttctaaatgaaatgttctggtgtgttttaaagactagaggaaaggttgtgttcacaacatgattactgtgtgtgttctgagacctcttgtattcatctgtgaaggggacgtgtattaatccatacactcctatagcctcgactatttgtctgaagacacttaaattttgaccagtaaaggaaagttctagaagcaatattttcactcctttagcattgtccaaataacatcaagtattaataaacgctgaagagtgtatttattttgtattactccaagtctgttggaatatgcaaggactgtggttataattagaatgtataaggcatattataatttagttcattctgaaaaagaagttagctgaacatctcttggttcatacatgttccaaattttgaacaatcttttgagttagccatagatttttctattttgtttttatttgtcaaggtatttttttcttcccttcatgaactttaggtacacataacttatgtcatttatttatggtcttttatacctagtttgtaaagttgtaaaatagcaaactaaatgcaaagagtttgcatttgaaagtaataaagtagttgccgtatacaaacctg

SEQ ID NO: 178 - protein, 986 aa, Mus musculus; identical to SEQ ID NO: 10

SEQ ID NO: 179 - DNA, 6364 bp, Homo sapiens
  CDS (43)..(3003)
ctgggatagaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaatatctgcagcgttgcttggtgcacagattgctgaaactgtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagaccatgcctaggaacattttttaaggactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgccatataaagtcttattttgggactttacaaacttgtcctaactatcttgtggatagtgggctgtgacaatctggaatagagaacgttcacacttcgctcctttaaagaagcgaccccagatctgcaagggagtagattctgctatcttggcctcacagcccttcctgttgattacaaagcccgtggaagaaaacagaacacaccctcctcagttccgtctaaatgtgtttcttctgcttcaattacaccagttctggggcaaagacactgatgaaacaacacccatacctgaaaagaataaatgtgtgactttcaaatcccctttcgcagtgaaagaaacagcaaacacttaagattcagcatctgttctccagttgcactgaggaatgcactgtctcgcagcaccagctctgcagagcccttgccccagactctttgcggttttatttatatgtatttccatatttcattcctgtgtgtcactgctgcattggtgtggcagcaagtgaccaaatgctacaggtcttactatggacaccaggtcaggtgcaaccacacaaaacaaagccagttccatgagctgcctatgatatgcattgcggaagtaacattttacccagggtgtgccattgcagtgatataaatatatttttttcttagactaaatatgagctgactatctcttttgatgtgtgtacataggtgtgagtgtgtgtgtatgcgtgcctgtctgtgtgcgggtgtgtgtatgtgcatagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatctacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcgaacgaatatatgcaattcatatacttttggagatgaacgtagatatgtgtgtcagctttgagatggtgtgtcctggattaatactttgtctcccaatatcacagaaaaatacatgccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgaggaaaaaaaatagattctgaaccatttattgttgaataagtagagaaaatcatcaataaatatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcagggtctgggtctgagcccgtgggcaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcattctgagacctcttgtattcaatctgtgaaggatatgtgtattaatccgtacacccgtatagcctcaatatttgtctgaagacacttaaattctgacccataaaggaaagttctagaagcaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaataagaaattaacagaacattgttcggttcacacgttccaaactttgagtgatttctggagttagacatagattttctattttgttttaatttgtcaaggtatttttcttcccttcatgaactttaggtacacataacttatgtcatttatttatggtcttttatacctagtttgtaaaattgtaaaatagcaaactaaatgcaaagagtttgcatttgaaaataataaagtagttgccgtatacaaccctgcaaaaaaaaaaaaaaaaaa

SEQ ID NO: 180 - protein, 986 aa, Homo sapiens; identical to SEQ ID NO: 6

SEQ ID NO: 181 - DNA, 3017 bp, Homo sapiens
  CDS (57)..(3017)
aagcatttattccactgggatagaagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcgtcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 182 - protein, 986 aa, Homo sapiens [sequence omitted]

SEQ ID NO: 183 - DNA, 3750 bp, Macaca mulatta
  CDS (172)..(2955)
aaaattcaagccagtgatatcctaggggtggaagacgagtctctgatggtccccaacacatcttgagaaagagagactacttgagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggccaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctgagccagtactgaataaactcaaaactcttgaaattagtttacctcatccatgcactttaattgaagaactgcactttttttacttcgtcttcgccctctgaaattaaagaaatttaaaaaaatgtctgcagcgttgcttggtgtacagattgctgaacctgtggggcttacagaaatgactgccggtcatctgaattagacctggaacaaatcgtttctcagaagtacttttctgttcatcaccagtctgtaaaatacatgtacctatagaaatagaacactgcctccgagttttgatgctgtatctgctgccggacactgagcttctgagacatccttgattctctttccatgtggaattacaaccattgtattttgtttgtggcataaattacagtcatctctctttcactggaatgaagaccatgcccaggaacatgttttaaggactcagctgtggcttttagggcttggttcataccatgggggaaaaaacatcctaggagaaagcgacgtggctcattagtgttgcctcttcagtgctcaagccacctggtgaattcctatgacgcagggggctggaaagaaagggaaagtggatttaaaaaaaaaaaatatatatatatatatacaaaaaaccaagccccataatccctaactggacaaatgaggtctgtttctttgggcctgaggctgtgccatataaagtcttattttaggactctacaaacttgtcctatcttatggatagtgggctgtgacaatctggaatagagaacgttcacacttcgctcct

SEQ ID NO: 184 - protein, 927 aa, Macaca mulatta
MDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 185 - DNA, 3126 bp, Equus caballus
  CDS (57)..(3017)
aagcatttattccactgggatagaagcggcaggagcagcgttggcaccggcgaatcatggctgggattttctatttcctcctcttttcgtttctctttgggatttgcgacgctgtcaccggttccagggtgtaccccgcgaatgaagttaccttgttggattccagatccgttcagggagaacttgggtggattgcaagccctctggaaggagggtgggaggaagtgagtattatggatgaaaaaaatacgccaatccgaacctaccaagtgtgcaacgtgatggaacccagccagaataactggctacgaactgactggatcacccgagaaggggctcagagggtgtacattgagattaagttcaccttgagggactgcaatagtcttccgggcgtcatggggacctgcaaggagacgtttaacctgtattattatgaatcagacaacgacaaagagcgtttcatccgagagagccagtttgccaagattgacaccatcgctgccgacgagagcttcacccaagtggacattggcgacagaatcatgaagctgaacacggagatccgggatgtagggccgctgagcaaaaaggggttttatctggcttttcaggatgtgggggcctgcattgccctggtatcggtccgcgttttctataagaagtgcccgctcacggttcgcaatctggcccagtttccagacaccatcacaggggccgatacgtcttccctggtggaagtccgaggctcctgtgtcaacaactcagaagagaaggatgtgccaaaaatgtactgtggggcagatggtgaatggctggtacccattggcaactgcctgtgcaatgctgggcatgaagagcggaatggagaatgccaagcctgcaaaattggatattacaaggctctctccacggatgccacctgtgccaagtgcccaccccacagctactccgtctgggaaggagccacatcgtgcacctgtgaccgcggctttttcagagccgacaatgatgctgcctctatgccctgcacccgcccaccgtctgctcccctcaacttgatttcaaatgtcaatgagacttcagtgaacttggaatggagcagtcctcagaacacgggtggccgccaggacatctcctacaacgtggtatgcaagaaatgtggagccggcgattccagcaagtgccggccctgcggaagtggagtccactataccccacagcagaatggcctgaagaccaccaaagtctccatcaccgacctcctggctcataccaattacacatttgaaatctgggcagtgaatggagtgtccaagtataaccccagcccggaccaatcagtgtccgtcaccgtgacaactaaccaagcagcaccatcatccattgctttggtgcaggctaaagaagttacaagatacagtgttgctctggcttggctggaaccagatcggcccaatggggtgatcctggagtatgaagtcaagtattatgagaaggatcagaatgagcgaagctatcggatcgtgcggacggctgccaggaacacggatatcaagggcctgaaccctctgacttcctacgtctttcatgtccgggccaggacagcagctggctatggagacttcagcgagcccctggaggtcacaaccaacacagtgccttcccggatcatcggagatggggccaactccactgtccttctggtctccgtctcaggcagtgtggtactggtggtcattctcatcgcagcctttgtcatcagtaggagacggagtaaatacagtaaagcaaaacaagaagcagatgaagagaaacatttgaatcaaggtgttagaacttatgtggatccttttacatacgaagatcccaaccaagcagttcgagaatttgccaaagaaatcgacgcatcttgcattaagattgaaaaagtcataggagttggtgaatttggcgaagtatgcagtgggcgtctcaaagtgcctggcaagagagagatctgtgtggccatcaagacactgaaagctggttatacagacaaacagaggagagacttcctgagcgaggccagcatcatgggacagtttgaccacccgaatataattcacctggaaggcgtcgtcaccaaatgtaaaccggtaatgatcataacagagtacatggagaatggctccttggatgcattcctcaggaagaatgacggcagatttacagtcattcagctggtgggcatgcttcgtggcattgggtctgggatgaagtatttatctgatatgagctatgtgcatcgagatctggctgcacggaacattctggtgaatagcaacttggtctgcaaagtgtctgattttggcatgtcgcgagtgcttgaggatgacccggaagcagcttataccaccaggggtggcaagattcctatccggtggactgcgccagaagcaattgcctatcgtaaattcacatcagcaagtgatgtatggagctatggaatcgttatgtgggaagtgatgtcgtatggagagagaccttattgggatatgtccaatcaagatgtgattaaagccattgaggaaggctatcgactaccccctccaatggactgccccattgccctccaccagctgatgctagactgctggcagaaggagagaagtgacaggcccaaatttgggcagattgtcaacatgttggacaaactcatccgcaaccccaacagcttgaagaggacggggactgagagctccagacctaacactgccttgttggatccgagctccccggaattctccgccgtagtatcggtgggcgattggctccaggccattaaaatggaccggtataaggataacttcacggctgctggttataccacactagaggctgtagtgcacgtgaaccaggatgacctggcaagaattgggatcaccgctgtcacacaccagaataagattttgagcagtgtccaggcgatgagaacccaaatgcagcagatacacggcagaatggttcctgtctgagccggtactgaataaactcaaaactcttgaaattagtttacctcatccatgcactttaattgaaggactgcacttttttttacttcgtcttcgccctccgaaattaaag

SEQ ID NO: 186 - protein, 986 aa, Equus caballus
MAGIFYFLLFSFLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRESQFAKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERNGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDSSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQDDLARIGITAVTHQNKILSSVQAMRTQMQQIHGRMVPV

SEQ ID NO: 187 - DNA, 2820 bp, Gallus gallus
cggagagagccagtttgccaagattgacaccattgctgctgatgagagcttcacccaggtggacattggtgacaggatcatgaagctgaatacagaggtgcgggacgtggggcctctcagcaagaaagggttttacttggctttccaggacgtcggtgcctgcattgctttggtgtctgttcgtgtcttctataagaagtgcccactgacagttcgaaacctggcacagtttccagacaccattactggggctgatacatcctctctggtggaggttcgtggctcctgtgtcaacaactcggaagagaaggacgtgccaaaaatgtactgcggggcagatggtgaatggctggtacccattggcaactgtctgtgcaatgctggctatgaagaacgcaatggtgaatgccaagcttgcaaaatcggatactacaaggcgctctcaacagatgttgcatgtgccaaatgcccgcctcacagctactccatctgggaaggctctacctcctgcacctgtgatcggggcttcttccgagcagaaaatgatgctgcatccatgccctgcactcgccctccatccgcaccccagaacctgatttccaacgtcaacgagacgtcagtgaacttggagtggagcgccccacagaacaagggaggacgggacgacatctcctacaacgtggtgtgcaagcgctgcggggcaggggagcccagccactgccggtcctgtggcagtggtgtacatttcagcccccagcagaacgggctgaaaaccacgaaggtttccatcactgacctcctggcacacaccaactacacctttgaggtctgggcagtgaatggagtgtccaagcacaaccccagccaggaccaagctgtgtcggtcactgtgacaactaaccaagcagctccatccccaattgcattgatccaggctaaagagataacgaggcacagcgttgccttggcctggctggaacctgacaggcccaatggagtcatcctggagtacgaagtcaagtactacgaaaaggaccaaaacgagcgcacgtatcgcattgtgaagacagcctccaggaatactgacatcaaaggtttgaaccccctgacttcatatgtatttcatgtgcgggccaggacagcagcaggatacggagacttcagtgggccgtttgagttcacaactaacacagttccttcccccatcattggcgatggtaccaatcccacagtgctgcttgtttcagtggctggcagtgttgttcttgtggtcattctcattgcagcctttgtcatcagcaggaggcgcagcaaatacagtaaagctaagcaagaggcagatgaggagaaacatttgaaccaaggtgtcagaacatatgtggatccttttacatatgaggatccaaatcaagctgtgagggaatttgccaaagaaattgatgcctcctgcataaagattgagaaagttattggtgtgggggaatttggtgaagtatgcagtggacgtctcaaagttccaggaaaaagagaaatctgtgtggctatcaagactctgaaagctggttacactgacaaacaacggagagacttcctgagtgaggccagcatcatgggacaatttgaccaccccaatatcatccacttggaaggcgttgttactaaatgtaaaccagtaatgatcataactgagtacatggagaatggctccttggatgccttcctccggaagaatgatggcagatttacagtaatccagttggtggggatgcttcgtggcatcggctcaggaatgaagtatctgtctgacatgagctatgtgcatcgggatctagctgctcgaaacatactggtcaacagcaacttggtctgcaaagtgtctgactttggcatgtcccgtgtcctggaagatgaccctgaggcagcttataccacacggggtggcaagatccctatccgatggactgcaccagaggcaattgcctaccgtaaatttacatcggctagtgacgtgtggagctatggcatcgtcatgtgggaagtgatgtcctatggagagagaccttactgggatatgtccaatcaagacgttattaaagccattgaggaagggtatcggttgccacccccaatggactgccccattgctctccatcagctgatgttagactgctggcagaaggaacgcagcgacagacctaaatttggacagattgtcaacatgctggacaaactcatccgcaaccctaacagcctgaagaggacaggcagcgagagctccagacccagcacagccctgctggatcccagctccccggagttctcggcggttgtttctgtcagtgactggctccaagccattaaaatggagcgatacaaggataacttcacagctgctggctataccaccctagaggctgtggtgcatatgaaccaggacgacctggccaggatcgggatcactgccatcacacaccagaacaagatcttgagcagcgttcaagccatgcgcagccaaatgcaacagatgcacggcaggatggtgcccgtctgagccagtactgaataaactcaaaactcttgaaattagtttacctcatccatgcactttaattgaagaactgcactttttttacttcgtctcctcgcccgttgaaataaagatctgcagcattgcttgatgtacagattgtggaaaccgagcgtgtgttgggaggggggcctccagaaatgacaagccgtcattttaaaccagacctggaacaaattgtttcttggaacatacttctctgttgatcaacgatatgtaaaatacatgtatcc

SEQ ID NO: 188 - protein, 849 aa, Gallus gallus
GESQFAKIDTIAADESFTQVDIGDRIMKLNTEVRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGYEERNGECQACKIGYYKALSTDVACAKCPPHSYSIWEGSTSCTCDRGFFRAENDAASMPCTRPPSAPQNLISNVNETSVNLEWSAPQNKGGRDDISYNVVCKRCGAGEPSHCRSCGSGVHFSPQQNGLKTTKVSITDLLAHTNYTFEVWAVNGVSKHNPSQDQAVSVTVTTNQAAPSPIALIQAKEITRHSVALAWLEPDRPNGVILEYEVKYYEKDQNERTYRIVKTASRNTDIKGLNPLTSYVFHVRARTAAGYGDFSGPFEFTTNTVPSPIIGDGTNPTVLLVSVAGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPSTALLDPSSPEFSAVVSVSDWLQAIKMERYKDNFTAAGYTTLEAVVHMNQDDLARIGITAITHQNKILSSVQAMRSQMQQMHGRMVPV

SEQ ID NO: 189 - DNA, 2961 bp, Sus scrofa
  CDS (1)..(2958)
atggctgggattttctatttcgtcctcttttcgtttctctttgggatttgcgacgctgtcaccggttccagggtatatcccgcaaatgaagttaccttattggattccagatctgttcagggagaacttgggtggatagcaagccctctggaaggagggtgggaggaagtgagtattatggatgaaaaaaatacaccaatccggacctaccaagtgtgcaacgtgatggaacccagccagaataactggctgcgaactgattggatcacccgagaaggggctcagagggtgtacattgagatcaagttcaccttgagggactgcaacagtcttccgggtgtcatgggcacgtgcaaggagacgtttaacctgtactactatgaatcagacaacgacaaagagcgttttatccgagagagccagtttgccaaaattgacaccatcgccgccgacgagagcttcacccaggtggacattggcgaccgaatcatgaagctgaacacagagatccgggatgtggggccactgagcaaaaaggggttctatctggcgtttcaggatgtgggagcctgcatcgccttggtatccgtccgcgtcttctacaagaagtgtccgctcacagttcgcaatctcgcccagtttccagacaccgtcacaggggcagatacgtcttctctggtggaagttcgaggctcctgtgtcaacaactcagaaaagaaggatgtgccaaaaatgtactgtggggcagatggtgaatggctggtacccattggcaactgtctatgcaatgctgggcatgaagagcggaatggagaatgccaagcttgcaaaattggatattacaaggccctctccacagatgccacctgtgccaagtgcccacctcacagctactctgtctgggaaggagccacatcctgcacctgtgaccgaggcttcttccgagccgacaatgatgctgcctctatgccctgcacccgcccaccatctgctcctctaaacttgatctcaaatgtcaatgagacatccgtgaacttggaatggagcagtcctcagaacacgggtggccgccaggacatttcctacaacgtcgtgtgcaagaagtgtggagcgggtgactctagcaagtgtcgaccttgtggaagtggggtccactacaccccacagcagaacggcctgaagaccaccaaggtctccatcactgacctcctggctcataccaactacacgtttgaaatctgggcagtgaatggtgtgtccaagtataaccctagcccggaccagtctgtgtctgtcactgtgaccaccaaccaagcagcaccctcctccattgctttggtccaggctaaagaagttacaagatacagcgtggccctggcttggctggaacctgatcggcccaatggtgtgatcttggaatatgaagtcaaatattatgagaaggatcagaacgaacgaagctatcgaatcgtcaggacagctgccaggaacacggatatcaaaggcctgaaccctctgacgtcctatgttttccatgtccgagcgaggacagcagctggctatggagacttcagcgagcccctggaggtcacaactaacacagtgccttcccggatcattggagatggggccaactccaccgtcctgctggtctccgtctcaggcagcgttgtgctggtggtcattctcatcgccgcctttgtcatcagcaggagacgaagtaaatacagtaaagcaaagcaagaagcagatgaagagaaacatttgaatcaaggtgttagaacttacgtggacccctttacctacgaagatcccaatcaagcagttcgagaatttgccaaagaaatcgacgcatcctgcattaagatcgaaaaagtcatcggagttggtgaatttggtgaagtatgcagtgggcgtctcaaagtgcctggcaaaagagaaatttatgtggctatcaagacgctgaaagctggttatacagacaaacagaggagggacttcctgagtgaggccagcatcatgggacagttcgaccaccccaatatcattcacttggaaggcgtcgtcaccaaatgtaaaccagtaatgatcataacagagtacatggagaacggctccttggacgcattcctcaggaagaatgatggcaggtttacggtcattcagctggtgggcatgcttcgtggcattgggtccgggatgaagtatttatcggatatgagctacgtgcatcgagacctggctgcacggaacattctagtcaatagcaacttggtctgcaaagtgtctgatttcggcatgtcccgggtgctggaggatgatccagaagccgcttatactaccaggggtggcaagattcctatccggtggactgcgccagaagcaattgcctatcgtaaattcacatcagcaagtgatgtatggagctacgggatcgttatgtgggaagtgatgtcgtatggagagagaccctactgggacatgtccaatcaagatgtgattaaagccatcgaggaaggctatcggctgccccctccaatggactgccccattgcactccaccagctgatgctggactgctggcagaaggagagaagcgacaggccgaaatttgggcagattgtcaacatgttggacaaactcatccgcaaccccaacagcttgaagaggacggggaccgagagctccagacctaacactgccttgttggatccaagctcccctgagttctctgccgtggtatcggtgggtgattggctccaggccattaaaatggaccgatataaggataacttcactgctgctggttataccacactagaggctgtagtgcacatgaaccaggatgacctggccagaattggcatcacggctgtcacacaccagaataagattttgaacagcatccaggcgatgagaacccaaatgcaacagatacacggcagaatggttcccgtctga

SEQ ID NO: 190 - protein, 986 aa, Sus scrofa
MAGIFYFVLFSFLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRESQFAKIDTIAADESFTQVDIGDRIMKLNTEIRDVGPLSKKGFYLAFQDVGACIALVSVRVFYKKCPLTVRNLAQFPDTVTGADTSSLVEVRGSCVNNSEKKDVPKMYCGADGEWLVPIGNCLCNAGHEERNGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDSSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREIYVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHMNQDDLARIGITAVTHQNKILNSIQAMRTQMQQIHGRMVPV

SEQ ID NO: 191 - DNA, 2961 bp, Ornithorhynchus anatinus
  CDS (1)..(2958)
atggctgggattttctatttcatcgtcttttcgcttctctttgggatttgcaacggggtgaccggttctcggatatatcccgcgaatgaagttaccttgctggattccagatcagttcagggagagcttggatggatagcaagtcctttagaaggagggtgggaggaagtgagcattatggatgagaaaaatactccaatacgcacctaccaagtctgcaatgtgatggagcccagccagaacaattggctacgaactgattggattccccgcgaaggggctcagagggtgtatatcgagattaaattcacactgagagactgcaacagcctgccaggtgtcatgggaacctgtaaggagaccttcaatctttactactacgaatcaaacaacgataaagaacgcttcatcagagaaagtcagtttgctaaaatcgacaccatcgctgccgatgaaagcttcacccaagtggacattggtgaccggatcatgaaattaaacaccgaaatccgtgacgtggggccattgagcaagaaagggttttacctggcttttcaggatgttggggcctgcattgccctggtatccgtgcgggtgttctacaagaagtgcccactgacagttcgcaacctggctcagtttcccgacaccgtcaccggggctgacacatcctccctagtggaggtccgaggctcctgtgttaataactcagaagagaaggatgttccaaagatgtattgtggggcagatggtgaatggttggtgcctattggcaactgtgtgtgcaatgctgggcacgaagagcgcaatggagaatgtcaagcctgtaaaattggatactacaaggccctgtccaccgacgcttcctgtgccaaatgtcctcctcatagctattccgtctgggaaggagccacctcttgcacctgtgacagaggatttttccgagcagacaacgatgccgcctctatgccctgcactcgtcctccctcggctcccctgaacctgatttccaaagtcaatgagacatcggtgaatttggagtggagcagccctcagaacacgggtggtcgacaggatatttcctataatgtggtatgcaagaaatgtggcaccggtgatctcagccgatgtcggtcctgtgggagtggagtacactacaccccccaacagaatggtctgaagagcaccaaagtctctatcactgacctcttggcacacacgaactacacctttgaaatctgggccgtgaacggagtatccaaacacaaccccagccatgaccaatcagtctctgtcacagttacgaccaatcaagcagctccttcttcaattgctttgatccaggctaaagaaataacaagatacagtgttgcgttagcttggttagagcctgataggccaaatggagtcatcttggagtatgaagtcaaatattatgagaaggatcagaatgaacgcagctaccgaattgttaggacagcatccagaaacactgatatcaaaggcctgaatcctttgacttcctatgtatttcatgtgcgggcccggaccgcagccggatatggagatttcagcgaaccgtttgaattcacaaccaacacagtcccttcacgaatcattggagatggtaccaattccacagtgcttctggcttcagttgcaggcagtgttgttctggtagtcattctcattgctgcatttgtcatcagcagaagacgcagtaaatacagcaaggctaagcaagaagcggatgaagagaaacatttgaatcaaggggtgagaacctatgtggatccttttacctatgaagatcctaaccaagctgtccgagaatttgccaaggaaatagatgcctcttgcatcaagattgaaaaagtcattggagttggtgagtttggcgaagtatgcagtgggcgtctcaaagtgcctggcaagcgggagatctgtgtggcaattaagactctcaaagcagggtatacggacaaacaaaggagggacttcttgagtgaggccagcatcatggggcagtttgaccaccctaatatcatccacttagaaggcgtcgtcaccaaatgtaagccagtaatgatcataaccgagtacatggaaaatggatccttggatgcattcctgaggaagaatgatggccgatttacagtcatacagttggtggggatgcttcgtggcattggctcgggaatgaagtatctgtccgatatgagttacgtgcatagggatctagctgcccgaaacatcctggtaaatagtaacctggtctgcaaagtgtccgattttggcatgtctcgagtacttgaggatgatcccgaagctgcttatacgacaaggggcggcaagattcccatccggtggactgcaccagaagcgatcgcatatcgtaaattcacatcagcaagtgatgtgtggagctatggaattgtaatgtgggaagtgatgtcatatggggagagaccgtactgggacatgtccaatcaagacgtaattaaagccatcgaagaaggatatagactacctccccctatggactgtcccattgcactccatcagctgatgcttgactgttggcagaaggagagaagtgacaggcctaaatttggacagattgtcaatatgttggacaaactcatccgcaaccccaacagcttgaagaggacgggcacggagagctccagacctaatactgccttgttggacccaagttctcctgaattctctgctgtggtgtcagtgactgactggctccaggccattaaaatggagcggtacaaggataacttcacagctgctggctacaccaccctagaggctgtggtgcacatgaaccaggacgacctgacaagaattggcatcaccgccatcacacatcagaacaagattttgggcagcgtccagtcaatgcggacccaaatgcaacagatgcacggcagaatggttcccgtctga

SEQ ID NO: 192 - protein, 986 aa, Ornithorhynchus anatinus
MAGIFYFIVFSLLFGICNGVTGSRIYPANEVTLLDSRSVQGELGWIASPLEGGWEEVSIMDEKNTPIRTYQVCNVMEPSQNNWLRTDWIPREGAQRVYIEIKFTLRDCNSLPGVMGTCKETFNLYYYESNNDKERFIRESQFAKIDTIAADESFTQVDIGDRIMKLNTEIRDVGPLSKKGFYLAFQDVGACIALVSVRVFYKKCPLTVRNLAQFPDTVTGADTSSLVEVRGSCVNNSEEKDVPKMYCGADGEWLVPIGNCVCNAGHEERNGECQACKIGYYKALSTDASCAKCPPHSYSVWEGATSCTCDRGFFRADNDAASMPCTRPPSAPLNLISKVNETSVNLEWSSPQNTGGRQDISYNVVCKKCGTGDLSRCRSCGSGVHYTPQQNGLKSTKVSITDLLAHTNYTFEIWAVNGVSKHNPSHDQSVSVTVTTNQAAPSSIALIQAKEITRYSVALAWLEPDRPNGVILEYEVKYYEKDQNERSYRIVRTASRNTDIKGLNPLTSYVFHVRARTAAGYGDFSEPFEFTTNTVPSRIIGDGTNSTVLLASVAGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVTDWLQAIKMERYKDNFTAAGYTTLEAVVHMNQDDLTRIGITAITHQNKILGSVQSMRTQMQQMHGRMVPV

SEQ ID NO: 193 - DNA, 3278 bp, Xenopus laevis
  CDS (73)..(3033)
aagggaagtggagcgggcacggtgtgtataggcatctcttaatccacctccggccccttagctgcagccaccatggctgggattgtacatggcatcttgttttgtggcctctttggactttgttgggcagtgacgggatctaggatttacccagccagtgaagttaccctgctggattccaggtcagtgcaaggagagcttggctggatagcaagtcctttggaaggagggtgggaagaagtgagtatcatggatgaaaagaatacacctatacgaacttaccaagtctgcaatgtcatggaatcgagccaaaacaactggttacggactgactggattccccgaagtggagctcagagagtatatgttgaaattaaatttacattaagggactgcaacagcttgcctggggtaatgggtacctgcaaagagacctttaatctgtattattatgagtccaacaatgacaaagagcgtttcattcgtgaaacccagtatgtgaaaatcgataccattgcagccgatgagagcttcacccaggttgatattggggaccgtattatgaagctgaacactgaggttagagatgttggtccactcagtaagaagggcttctacttggccttccaggatgtgggagcatgcattgcccttgtgtctgtccgagtgttctacaagaagtgtccattgactgtaagaaacttggcacagttccctgacaccattacaggttcagacacctcttctttggtggaagttcgaggctcttgtgtagacaactcagaagagaaagatgtgcctaagatgtactgtggtgctgatggagagtggctggtgcccattggaaactgcttatgtaacgctgggtttgaggagcacaatggaggatgccaagcctgcaaagttggatactacaaagccctctcaacagatgcagcttgctccaagtgtcccccacacagttatgctctccgggaaggctcaacctcctgcacctgtgaccgtggctattttcgagctgacactgacccggcttctatgccctgcactagacccccatctgctcctcagaacctaatctcaaacgtcaatgagacatctgtgaatttggagtggagtccgccacaaaattctggtggaaggcctgatgtctcctacaatttggtctgtaaaaggtgcggctctgacctgactcgctgtcggccttgtggcagtggagtgcactatagcccccagcaaaatggcctgaagactaccaaagtgtccattaatgacctgcaagcccatactaactacacctttgaggtctgggccattaatggtgtctccaagcagaaccctgaacaagatcaggctgtgtcagttactgtgaccaccaaccaagctgctccttcaactgtaacccagatacagccaaaagagatcaccaggcacagtgtgtctttgacttggccagagcctgagcgagccaatggggtcatcctggaatacgaagtcaagtattatgagaaggaccagaatgagcgtagttatcgaattgttaagacggcctcgcgaagtgcagacatcaaaggtctcaacccccttactggttatgtgttccatgttcgtgctcggacagctgcaggatatggggagttcagtggaccctttgagttcaccacgaatacagtgccatccccgatgattggcgaaggaaccagccccactgtgcttttggtgtccgtggctggaagcattgtccttgtggtcattctcattgctgcttttgtcatcagcagaagacggagtaaatacagtaaagccaagcaggaagcagacgaggaaaaacatttaaaccaaggagtaaagacttatgtggacccatttacatatgaagatcctaaccaggctgtccgcgaatttgcaaaggaaatcgatgcctcttgtattaagatcgaaaaagtaattggagtaggtgaatttggtgaagtgtgcagtgggcgtctgaaggtccctggaaagagagagatttatgttgcaattaagaccctgaaagctggttacaccgataagcagaggagagactttctcagtgaggccagcatcatgggtcagtttgaccatcctaacatcatccaccttgaaggtgttgtcaccaaatgcaagccagtgatgataatcaccgagtacatggagaacggatccttggatgcattccttcggaagaatgatggtcggtttacagtaatacagcttgtgggaatgctgcgtggcattgggtctggaatgaaatacctttcggacatgagttatgtgcaccgggacctagctgctcgtaatatccttgtgaacagcaacctagtctgtaaggtctctgactttggcatgtctcgggtgctggaagatgaccctgaagcagcctacacaaccaggggtggcaagatcccaatccgatggactgcaccagaagctattgcatacaggaaattcacttctgctagtgatgtctggagctatggcattgtcatgtgggaagtcatgtcttatggagagaggccttactgggatatgtccaatcaagatgtaattaaagcaatcgaggaaggatacaggctgcccccgcctatggactgccctattgcactgcatcagctcatgttggactgctggcagaaggatcgtagtgaccgaccaaaatttgggcagatagtcagcatgctggataaactcatcaggaacccaaacagtttgaaaaggactgggctggagaattcaagcagaacaaatacggctctgctggaccccagttcgcctgaatggtcccaggtggcttctgtgcttgattggctgcaggccatcaaaatggaaagatacaaagataacttcacagcagccggatacaccagcttggaagcagtcgtgcatgtgaatcaagatgacttgaccaggattggcattagttccccttcacaccagaacaagatcctgagcagcgtccaaggaatgaggacccagttgcagcaaatgcaaggcaggatggttcctgtttgaagctgcaggacgtcaaagggggggcaatttctcagaactcttgaaagaaaaattagtttacctcatccatgcactttaattgaagaactgcactttttttacattatcctcaccccgtgggacaaggactctgcagaagtatttggggataagctgaaactcatttaacatggagcatttgtgcaacacagttttggaagatcgtgcgtcagcaacttaaggatgtagacaaaaaaaaaaaaaaa

SEQ ID NO: 194 - protein, 986 aa, Xenopus laevis; identical to SEQ ID NO: 50

SEQ ID NO: 195 - DNA, 1203 bp, Rattus norvegicus
  CDS (1)..(1200)
aagcatttgaatcaaggtgttagaacatacgtggatccctttacatatgaagaccccaaccaggcagttcgagaatttgccaaagaaatcgatgcctcctgcattaaaatcgaaaaggtcattggagttggcgaatttggagaagtctgcagtgggcgtctcaaagtgcccggcaagagagagatctgtgtggccatcaagactctgaaagctggttatactgacaagcagaggagagacttcctgagcgaggccagcatcatgggacagtttgaccacccaaacataatccacctggaaggcgttgtcaccaaatgtaaaccagtaatgatcatcacggagtacatggagaacggctccttggacgctttcctcaggaagaatgatggccgatttacagtcattcagctggtgggcatgctccgaggcattggctcggggatgaagtatttatctgatatgagctatgtgcatcgagacctggctgccaggaacattctggtaaatagcaacttggtctgcaaggtgtctgatttcggcatgtccagggtgcttgaggatgacccggaagcagcctatactaccaggggcggcaagattcccatccggtggactgcaccagaagcaattgcgtatcgtaaatttacctcagccagtgacgtctggagctacggaatcgttatgtgggaagtgatgtcatatggagagaggccgtactgggatatgtccaatcaagatgtgatcaaagccatcgaggaagggtaccggctacccccgccaatggactgccccattgccctccatcagttaatgctggactgttggcagaaagagagaagcgacaggcctaaatttgggcagatcgtcaacatgttggacaaactcatccgcaaccccaacagcctgaagaggacagggccagagagttccagaccaaacacagccttgttagatcccagctcccctgaattctccgccgtagtatcagtgggtgactggctgcaggccatcaaaatggaccggtataaggacaacttcacagccgccgggtacacgacactagaagctgtggttcacatgagccaggatgacctggcgcgaattggcatcaccgcaatcacgcaccagaataagattttgagcagcgtccaggcgatgcgaacccagatgcagcagatgcatggcaggatggttcctgtctga

SEQ ID NO: 196 - protein, 400 aa, Rattus norvegicus
KHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGPESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 197 - DNA, 1317 bp, Rattus norvegicus
atggactacccatacgacgtcccagactacgctacgcgtgtcgacattgcggcatttgtgatcagccgtagacggagtaagtacagccaagcaaagcaagaagcagatgaagagaagcatttgaatcaaggtgttagaacatacgtggatccctttacatatgaagaccccaaccaggcagttcgagaatttgccaaagaaatcgatgcctcctgcattaaaatcgaaaaggtcattggagttggcgaatttggagaagtctgcagtgggcgtctcaaagtgcccggcaagagagagatctgtgtggccatcaagactctgaaagctggttatactgacaagcagaggagagacttcctgagcgaggccagcatcatgggacagtttgaccacccaaacataatccacctggaaggcgttgtcaccaaatgtaaaccagtaatgatcatcacggagtacatggagaacggctccttggacgctttcctcaggaagaatgatggccgatttacagtcattcagctggtgggcatgctccgaggcattggctcggggatgaagtatttatctgatatgagctatgtgcatcgagacctggctgccaggaacattctggtaaatagcaacttggtctgcaaggtgtctgatttcggcatgtccagggtgcttgaggatgacccggaagcagcctatactaccaggggcggcaagattcccatccggtggactgcaccagaagcaattgcgtatcgtaaatttacctcagccagtgacgtctggagctacggaatcgttatgtgggaagtgatgtcatatggagagaggccgtactgggatatgtccaatcaagatgtgatcaaagccatcgaggaagggtaccggctacccccgccaatggactgccccattgccctccatcagttaatgctggactgttggcagaaagagagaagcgacaggcctaaatttgggcagatcgtcaacatgttggacaaactcatccgcaaccccaacagcctgaagaggacagggccagagagttccagaccaaacacagccttgttagatcccagctcccctgaattctccgccgtagtatcagtgggtgactggctgcaggccatcaaaatggaccggtataaggacaacttcacagccgccgggtacacgacactagaagctgtggttcacatgagccaggatgacctggcgcgaattggcatcaccgcaatcacgcaccagaataagattttgagcagcgtccaggcgatgcgaacccagatgcagcagatgcatggcaggatggttcctgtctga

SEQ ID NO: 198 - DNA, 1485 bp, Artificial
  synthetic DNA
atgtctgcacttctgatcctagctcttgttggagctgcagttgctggatcggaattcacgcgtgtcgaggtcactaccaatacagtgccttcccgaatcattggtgatggggccaactctaccgtcctgctggtctccgtctctggcagtgtagtactcgtggtcattctcattgcggcatttgtgatcagccgtagacggagtaagtacagccaagcaaagcaagaagcagatgaagagaagcatttgaatcaaggtgttagaacatacgtggatccctttacatatgaagaccccaaccaggcagttcgagaatttgccaaagaaatcgatgcctcctgcattaaaatcgaaaaggtcattggagttggcgaatttggagaagtctgcagtgggcgtctcaaagtgcccggcaagagagagatctgtgtggccatcaagactctgaaagctggttatactgacaagcagaggagagacttcctgagcgaggccagcatcatgggacagtttgaccacccaaacataatccacctggaaggcgttgtcaccaaatgtaaaccagtaatgatcatcacggagtacatggagaacggctccttggacgctttcctcaggaagaatgatggccgatttacagtcattcagctggtgggcatgctccgaggcattggctcggggatgaagtatttatctgatatgagctatgtgcatcgagacctggctgccaggaacattctggtaaatagcaacttggtctgcaaggtgtctgatttcggcatgtccagggtgcttgaggatgacccggaagcagcctatactaccaggggcggcaagattcccatccggtggactgcaccagaagcaattgcgtatcgtaaatttacctcagccagtgacgtctggagctacggaatcgttatgtgggaagtgatgtcatatggagagaggccgtactgggatatgtccaatcaagatgtgatcaaagccatcgaggaagggtaccggctacccccgccaatggactgccccattgccctccatcagttaatgctggactgttggcagaaagagagaagcgacaggcctaaatttgggcagatcgtcaacatgttggacaaactcatccgcaaccccaacagcctgaagaggacagggccagagagttccagaccaaacacagccttgttagatcccagctcccctgaattctccgccgtagtatcagtgggtgactggctgcaggccatcaaaatggaccggtataaggacaacttcacagccgccgggtacacgacactagaagctgtggttcacatgagccaggatgacctggcgcgaattggcatcaccgcaatcacgcaccagaataagattttgagcagcgtccaggcgatgcgaacccagatgcagcagatgcatggcaggatggttcctgtcgcggccgcaatggactacccatacgacgtcccagactacgcttag

SEQ ID NO: 199 - DNA, 630 bp, Rattus norvegicus
  CDS (1)..(627)
atggagcagaagcttatcagcgaggaggacctggaattcacgcgtgtcgacatgcaggccatcaagtgtgtggtggtgggagacggagccgttggtaaaaactgcctgctcatcagttacacgaccaatgcgttccctggagagtacatccccaccgtctttgacaactattctgccaatgttatggtagatggaaaaccagtgaatctgggcctctgggacacagctggacaggaagattatgacagactgcgtcccctctcctacccgcaaacagacgtgttcttaatttgcttttcccttgtgagtcctgcatcatttgaaaatgtccgtgcaaagtggtatcctgaagtacgacaccactgtcccaatactcccatcatcctagtggggacgaagcttgatcttagggatgataaggacacgattgagaagctgaaggagaagaagctgactcccattacctacccgcaggggctagccatggcgaaagagatcggtgctgtcaaatacctggagtgctcagcactcacacagcgaggactcaagacagtgtttgatgaagctatccgagccgttctctgtccccctcctgttaagaagaggaagagaaaatgcctgctgttgtaa

SEQ ID NO: 200 - protein, 209 aa, Rattus norvegicus
MEQKLISEEDLEFTRVDMQAIKCVVVGDGAVGKNCLLISYTTNAFPGEYIPTVFDNYSANVMVDGKPVNLGLWDTAGQEDYDRLRPLSYPQTDVFLICFSLVSPASFENVRAKWYPEVRHHCPNTPIILVGTKLDLRDDKDTIEKLKEKKLTPITYPQGLAMAKEIGAVKYLECSALTQRGLKTVFDEAIRAVLCPPPVKKRKRKCLLL

SEQ ID NO: 201 - DNA, 4829 bp, Artificial
  synthetic DNA
aattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattggagctccaccgcggtggcggccgctctagaactagtggatcccccgggctgcaggaatctagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgcggtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttgttgtgctgtctcatcattttggcaaagaattgatttcgatacgtacggttgaattcagatctaagcttgatatcgtcgacgctagcaacttgtttattgcagcttataatggttacaaataaagcaatagcatcacaaatttcacaaataaagcatttttttcactgcattctagttgtggtttgtccaaactcatcaatgtatcttatcatgtctggatctcgacctcgagggggggcccggtacccagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 202 - DNA, 6469 bp, Artificial
  synthetic DNA
  misc_feature (1355)..(1355): n is a, c, g, or t
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccacaattgtcgtgtctctgagtgtgcttccagtgcccccctccccccaaaaaatgccttctgagttgaatatcaacactacaaaccgagtatctgcagagggccctgcgtatgagtgcaagtgggttttaggaccaggatgaggcggggtgggggtgcctacctgacgaccgaccccgacccactggacaagcacccaacccccattccccaaattgcgcatcccctatcagagagggggaggggaaacaggatgcggcgaggcgcgtgcgcactgccagcttcagcaccgcggacagtgccttcgcccccgcctggcggcgcgcgccaccgccgcctcagcactgaaggcgcgctgacgtcactcgccggtcccccgcaaactccccttcccggccaccttggtcgcgtccgcgccgccgccggcccagccggaccgcaccacgcgaggcgcgagataggggggcacgggcgcgaccatctgcgctgcggcgccggcgactcagcgctgcctcagtctgcggtgggcagcggaggagtcgtgtcgtgcctgagagcgcagctgtgctcctgggcaccgcgcagtccgcccccgcggctcctggccagaccacccctaggaccccctgccccaagtcgcatcgattgaattccccggggatcctctagagtcgacctgcagaagcttccacaaccatggtgagcaagggcgaggagctgttcaccggggtggtgcccatcctggncgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaactcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 203 - DNA, 39 bp, Artificial
  synthetic DNA
gagctcgaggccaccatggctgggattttctatttcatc

SEQ ID NO: 204 - DNA, 36 bp, Artificial
  synthetic DNA
gaggcggccgcgacaggaaccatcctgccatgcatc

SEQ ID NO: 205 - DNA, 33 bp, Artificial
  synthetic DNA
gagctcgagcgtagacggagtaagtacagccaa

SEQ ID NO: 206 - DNA, 33 bp, Artificial
  synthetic DNA
gaggtcgacatgcaggccatcaagtgtgtggtg

SEQ ID NO: 207 - DNA, 34 bp, Artificial
  synthetic DNA
gaggcggccgcttacaacagcaggcattttctct

SEQ ID NO: 208 - DNA, 32 bp, Artificial
  synthetic DNA
gaggtcgacaagcatttgaatcaaggtgttag

SEQ ID NO: 209 - DNA, 31 bp, Artificial
  synthetic DNA
gaggtcgacaaaatcgaaaaggtcattggag

SEQ ID NO: 210 - DNA, 31 bp, Artificial
  synthetic DNA
gaggtcgacgacaagcagaggagagacttcc

SEQ ID NO: 211 - DNA, 31 bp, Artificial
  synthetic DNA
gaggtcgactacatggagaacggctccttgg

What is claimed is:

1. A method of screening for compounds which affect the processing of EphA4 by γ-secretase, comprising the following steps:
   (i) culturing neuronal cells in the presence and absence of a candidate compound under conditions that allow the cleavage of EphA4 by γ-secretase;
   (ii) measuring the number of dendritic spines in said neuronal cells in the presence and absence of the candidate compound;
   (iii) assessing the cleavage of EphA4 by γ-secretase with an antibody specific for cleaved EphA4;
   (iv) selecting those candidate compounds which affect the number of dendritic spines based on the number of spines measured in step (ii) and the cleavage of EphA4 in step (iii); and
   (v) identifying the candidate compounds selected in step (iv) as compounds which affect the processing of EphA4 by γ-secretase.

2. The method according to claim 1, comprising identifying a candidate compound as a compound which activates the processing of EphA4 through γ-secretase when the number of dendritic spines in the presence of said candidate compound was increased relative to the number of dendritic spines in the absence of said candidate compound in the measurement of dendritic spines in step (ii).

3. The method according to claim 1, comprising identifying a candidate compound as a compound which inhibits the processing of EphA4 through γ-secretase when the number of dendritic spines in the presence of said candidate compound was decreased relative to the number of dendritic spines in the absence of said candidate compound in the measurement of dendritic spines in step (ii).

4. A method of screening for compounds which affect dendritic spine formation in neuronal cells by γ-secretase-processed EphA4, comprising the following steps:
   (i) culturing dendritic spine forming neuronal cells which have been transfected to express γ-secretase-cleaved intracellular EphA4 fragment;
   (ii) measuring the number of dendritic spines in the dendritic spine forming cells cultured in step (i) in the presence and absence of a candidate compound;
   (iii) selecting those candidate compounds which affect the number of spines based on the number of spines measured in step (ii); and
   (iv) identifying the candidate compounds selected in step (iii) as compounds which affect dendritic spine formation in neuronal cells by γ-secretase-processed EphA4.

5. The method according to claim 4, comprising evaluating a candidate compound as a compound which activates dendritic spine formation through γ-secretase-cleaved EphA4 when the number of dendritic spines after the expression of γ-secretase-cleaved EphA4 was increased relative to the number of dendritic spines before the expression of γ-secretase-cleaved EphA4 in the measurement of spines in step (ii).

6. The method according to claim 4, comprising evaluating a candidate compound as a compound which inhibits dendritic spine formation through γ-secretase-cleaved EphA4 when the number of dendritic spines after the expression of γ-secretase-cleaved EphA4 was decreased relative to the number of dendritic spines before the expression of γ-secretase-cleaved EphA4 in the measurement of spines in step (ii).

7. A method of screening for compounds which affect dendritic spine formation in neuronal cells by γ-secretase-processed EphA4, comprising the following steps:
   (i) culturing Rac expressing cells which have been transfected to express γ-secretase-cleaved intracellular EphA4 fragment;

(ii) measuring the Rac activity in the Rac expressing cells cultured in step (i) in the presence and absence of a candidate compound;

(iii) selecting those candidate compounds which affect Rac activity based on the measuring in step (ii); and (iv) identifying the candidate compounds selected in step (iii) as compounds which affect dendritic spine formation in neuronal cells by γ-secretase-processed EphA4.

8. The method according to claim 7, comprising evaluating a candidate compound as a compound which activates dendritic spine formation through γ-secretase-cleaved EphA4 when the Rac activity in the presence of said candidate compound was increased relative to the Rac activity in the absence of said candidate compound in the measurement of Rac activity in step (ii).

9. The method according to claim 7, comprising evaluating a candidate compound as a compound which inhibits dendritic spine formation through EphA4 when the Rac activity in the presence of said candidate compound was decreased relative to the Rac activity in the absence of said candidate compound in the measurement of Rac activity in step (ii).

10. A method of screening for compounds which affect Rac activity mediated by γ-secretase-processed EphA4, comprising the following steps:

(i) culturing Rac expressing cells which have been transfected to express γ-secretase-cleaved intracellular EphA4 fragment;

(ii) measuring Rac activity in the Rac expressing cells cultured in step (i) in the presence and absence of a candidate compound;

(iii) selecting those candidate compounds which affect Rac activity based on the measuring step in (ii); and (iv) identifying the candidate compounds selected in step (iii) as compounds which affect Rac activity mediated by γ-secretase-processed EphA4.

11. The method according to claim 10, comprising evaluating a candidate compound as a compound which activates Rac through γ-secretase-cleaved EphA4 when the Rac activity in the presence of said candidate compound was increased relative to the Rac activity in the absence of said candidate compound in the measurement of Rac activity in step (ii).

12. The method according to claim 10, comprising evaluating a candidate compound as a compound which inhibits Rac activity through EphA4 when the Rac activity in the presence of said candidate compound was decreased relative to the Rac activity in the absence of said candidate compound in the measurement of Rac activity in step (ii).

* * * * *